(12) United States Patent  
Roth et al.

(10) Patent No.: US 7,510,835 B2
(45) Date of Patent: Mar. 31, 2009

(54) METHODS FOR IDENTIFYING RISK OF BREAST CANCER AND TREATMENTS THEREOF

(75) Inventors: Richard B. Roth, La Jolla, CA (US); Matthew Roberts Nelson, San Marcos, CA (US); Stefan M. Kammerer, San Diego, CA (US); Andreas Braun, San Diego, CA (US); Rikard Reneland, San Diego, CA (US)

(73) Assignee: Sequenom, Inc., San Diego, CA (US)

( * ) Notice: Subject to any disclaimer, the term of this patent is extended or adjusted under 35 U.S.C. 154(b) by 299 days.

(21) Appl. No.: 10/723,681

(22) Filed: Nov. 25, 2003

(65) Prior Publication Data

US 2005/0192239 A1    Sep. 1, 2005

Related U.S. Application Data

(60) Provisional application No. 60/490,234, filed on Jul. 24, 2003, provisional application No. 60/429,136, filed on Nov. 25, 2002.

(51) Int. Cl.
- *C12Q 1/68* (2006.01)
- *C12P 19/34* (2006.01)
- *C07H 21/04* (2006.01)
- *C07H 21/02* (2006.01)

(52) U.S. Cl. .................. 435/6; 435/91.1; 435/91.2; 536/23.1; 536/24.3

(58) Field of Classification Search ............... None
See application file for complete search history.

(56) References Cited

U.S. PATENT DOCUMENTS

| 5,482,954 | A | 1/1996 | Kohn et al. |
| 5,547,835 | A | 8/1996 | Koster |
| 5,605,798 | A | 2/1997 | Koster |
| 5,691,141 | A | 11/1997 | Koster |
| 5,849,542 | A | 12/1998 | Reeve et al. |
| 5,869,242 | A | 2/1999 | Kamb |
| 5,928,906 | A | 7/1999 | Koster et al. |
| 6,013,431 | A * | 1/2000 | Soderlund et al. .............. 435/5 |
| 6,043,031 | A | 3/2000 | Koster et al. |
| 6,130,058 | A | 10/2000 | Le Bourdelles et al. |

(Continued)

FOREIGN PATENT DOCUMENTS

WO    WO 90/00607    1/1990

(Continued)

OTHER PUBLICATIONS

Thisted et al; 1998, from the internet at galston.uchicago.edu/~thisted/, pp. 1-6.*

(Continued)

*Primary Examiner*—Jehanne S Sitton
(74) *Attorney, Agent, or Firm*—Grant Anderson LLP

(57) ABSTRACT

Provided herein are methods for identifying risk of breast cancer in a subject and/or a subject at risk of breast cancer, reagents and kits for carrying out the methods, methods for identifying candidate therapeutics for treating breast cancer, and therapeutic methods for treating breast cancer in a subject. These embodiments are based upon an analysis of polymorphic variations in nucleotide sequences within the human genome.

73 Claims, 146 Drawing Sheets

MAPK10

U.S. PATENT DOCUMENTS

| | | | |
|---|---|---|---|
| 6,194,144 | B1 | 2/2001 | Koster |
| 6,258,538 | B1 | 7/2001 | Koster et al. |
| 2002/0142464 | A1 | 10/2002 | Glucksman |
| 2002/0155440 | A1 | 10/2002 | Ljumbimova et al. |
| 2005/0064442 | A1 | 3/2005 | Roth et al. |
| 2005/0272043 | A1 | 12/2005 | Roth et al. |

FOREIGN PATENT DOCUMENTS

| | | |
|---|---|---|
| WO | WO 99/33962 | 7/1999 |
| WO | WO01/51666 | 7/2001 |
| WO | WO 02/053018 | 7/2002 |
| WO | WO 2004/047514 | 6/2004 |
| WO | WO 2006062716 | 6/2006 |
| WO | WO 2006096561 | 9/2006 |
| WO | WO 2006096737 | 9/2006 |

OTHER PUBLICATIONS

Hacker et al; Gut, 1997, vol. 40, pp. 623-627.*
Pennisi, Science, 1998; 281 (5384):1787-1789.*
Malhotra et al; Am. J. Of Psychiatry, vol. 161, pp. 780-796, May 2004.*
rs1541998, 2000; dbSNP, NCBI.*
Kroese et al. (Genetics in Medicine, vol. 6 (2004), p. 475-480.*
Bassal et al., Genomics, 77(1-2):5-7 (2001).
Bosher et al., Proc. Natl. Acad. Sci. USA, 92:744-747 (1995).
Chen et al., Genes Chromosomes Cancer, 31:333-344 (2001).
Ezumi et al., Biochem. Biophys. Res. Commun., 277:27-36 (2000).
French et al., British J. Cancer, 87:1034-1041 (2002).
Imhof et al., Mol. Cell. Biol. 19:194-204 (1999).
Kammerer et al., Cancer Res., 64:8906-8910 (2004).
Kammerer et al., Proc. Natl. Acad. Sci. USA, 102(6):2004-2009 (2005).
Kim et al., Biochem. Biophys. Res. Commun., 281:1106-1112 (2002).
Makino et al., Oncogene, 14:2425-2433 (1997).
NCBI database, NCBI, NLM, NIH (Bethesda MD, USA) Accession # SNP rs6804951 NCBI Assay ID ss10090614 Jun. 2003.
NCBI SNP database, NCBI, NLM, NIH (Bethesda MD, USA) Accession # 1134985, NCBI Assay ID (ss#) 1536884 Sep. 13, 2000.
NCBI SNP database, NCBI, NLM, NIH (Bethesda MD, USA) Accession # SNP rs1011058 NCBI Assay ID ss1473871, (Sep. 7, 2000).
NCBI SNP database, NCBI, NLM, NIH (Bethesda MD, USA) Accession # SNP rs3812851 NCBI Assay ID ss4999260 (Aug. 12, 2002).
Roth et al., Genomics, 63:384-390 (2000).
Rozenblum et al., Hum. Genet., 110:111-121 (2002).
The SNP Consortium, SNP Report for TSC0850275, Sanger Center, Dec. 25, 2000.
Zapata-Benavides et al., Biochem. Biophys. Res. Commun., 295(4):784-790 (2002).
Zheng et al., Nat. Genet., 15(1):78-82 (1997).
Elbashir et al., Methods 26(2):199-213 (2002).
Forbes, Seminars in Oncology, 24(1)Suppl.1:S1-20-S1-35 (1997).
Ford et al., British J. Cancer, 72:805-812 (1995).
Miki et al., Science, 266:66-71 (1994).
NCBI database, NCBI, NLM, NIH (Bethesda MD, USA) Accession # A1 199660 NCBI Assay ID ss3752266 Dec. 12, 1998.
NCBI database, NCBI, NLM, NIH (Bethesda MD, USA) Accession # SNP rs11549918 NCBI Assay ID ss16249946 Nov. 2003.
Wooster et al., Science, 265:2088-2090 (1994).
Edwards et al., "Complement Factor H Polymorphism and Age-Related Macular Degeneration," Science 308:421-424, Apr. 15, 2005.
Hageman et al., "A common haplotype in the complement regulatory gene factor H (HF1/CFH) predisposes individuals to age-related macular degeneration," PNAS May. 17, 2005, 102(20):7227-7232.
Haines et al., "Complement Factor H Variant Increases the Risk of Age-Related Macular Degeneration," Science 308:419-421, Apr. 15, 2005.
Hara et al., "Hepatocyte Nuclear Factor-4a P2 Promoter Haplotypes Are Associated with Type 2 Diabetes in the Japanese Population," Diabetes 55:1260-1264, May 2006.
Hegele et al., "SNP judgments and freedom of association.", Arterioscler Tromb Vasc Biol, 2002;33:1058-1061.
Hoyal et al., "Genetic polymorphisms in DPF3 associated with risk of breast cancer and lymph node metastases," J. Carcinogenisis, 2005, vol. 4:13:1-9.
Klein et al., "Complement Factor H Polymorphism in Age-Related Macular Degeneration," Science 308:385-389, Apr. 15, 2005.
Kroese et al., "Genetic tests and their evaluation: can we answer the key questions?" Genetics in Medicine, vol. 6 (2004), p. 475-480.
Lin and Liu, "Linkage and association analyses of microsatellites and single-nucleotide polymorphisms in nuclear families," BMC Genetics, 6:S25:1-5 Dec. 30, 2005.
Mummidi et al., "Evolution of human and non-human primate CC chemokine receptor 5 gene and mRNA. Potential roles for haplotype and mRNA diversity, differential haplotype-specific transcriptional activity, and altered transcription factor binding to polymorphic nucleotides in the pathogenesis of HIV-1 and simian immunodeficiency virus", J Biol. Chem. Jun. 23, 2000; 275(25):18946-18961.
refSNP for rs1990440, available online at www.ncbi.nlm.nih.gov, pp. 1-4.
Vazza et al., "Genome-Wide scan supports the existence of a susceptibility locus for schizophrenia and bipolar disorder on chromosome 15q26," Molecular Psychiatry 12, 87-93. 2007.
Xiao-Lin et al., "A novel unclear-encoded mitochondrial poly(A) polymerase PAPD1 is a potential candidate gene for the extreme obesity related phenotypes in mammals," Int. J. Biol. Sci. 2006 2(4):171-178.
Zareparsi et al., "Strong Association of the Y402H Variant in Complement Factor H at 1q32 with Susceptibility to Age-Related Macular Degeneration," Am. J. Hum. Genet. 77:149-153, 2005.
Hart et al., J.Biol.Chem. 269:62-65, (1994).
Hashida T et al. Endocrinology 143(7):2808-11 (Jul. 2002).
Helene et al., Ann NY Acad Sci., Oct. 28, 1992, vol. 660, pp. 27-36.
Helene, Anticancer Drugs Des., 1991, V. 6, No. 6, pp. 569-584.
Maher, Bioessays., Dec. 1992, vol. 14, No. 12, pp. 807-815.
Suzuki et al., J. Biol. Chem. 262:611-616, (1987).
Supplementary European Search Report, Sep. 29, 2006.
Kristensen, et al., "Genetic variants of CYP19 (aromatase) and breast cancer risk," Oncogene, vol. 19, No. 10, pp. 1329-1333, (Mar. 2, 2000).
Park, et al., "Polymorphisms of tumor necrosis factors A and B in breast cancer" European Journal of Immunogenetics, vol. 29, No. 1, pp. 7-10 Feb. 1, 2002.
NCBI SNP database, Accession #rs1799969.
Cantor & Smith, *Genomics: The Science and Technology Behind the Human Genome Project*, 1999, John Wiley & Sons, Inc., New York, pp. 164-167, 170-173, 180-181 and 190-193.
Cantor & Nelson, "Haplotyping in biomedicine—practical challenges," Nature Biotech 23: 21-22 (2005).
Database SNP Accession No. rs484315.
Li Zhong You et al. "Genomic structure of the human beta-PIX gene and its alteration in gastric cancer." Cancer Letters, Mar. 28, 2002 pp. 203-208.
Supplementary European Search Report for EP04753723 completed Aug. 10, 2007.
Database on NCBI: Single Nucleotide Polymorphism, dbSNP rs1056538, Lee, Sep. 13, 2000.
Cox et al., "Polymorphisms in the ICAm gene locus are not associated with breast cancer risk." Cancer Epidemiol Biomarkers Prev. Jan. 2006, vol. 15, No. 1, pp. 178-179.
Cox et al., "A common coding variant in CASP8 is associated with breast cancer risk." Nature Genetics, Mar. 2007, vol. 39, No. 3, pp. 352-358.
International Search report in PCT/US05/44718, mailed Nov. 15, 2007.

* cited by examiner

FIGURE 1-A

ICAM REGION GENOMIC

>19:10203901-10296400

```
1       agcgagactc cgtctcaaaa aaaaaaaaaa aaaaaaaaaa gccaggcgag gtgactcaca
61      cccataatcg cagcactttg ggaggccaag gcgggcagat cgcttgagcc cagaagtttg
121     agatctgcct gggcaacaYg gcgagaccct gtctctatga aacaagaaaa aagaaagaaa
181     cgaaatactg ttccatcatt tgccacataa aatctaaact ctctggtgca gaacagactt
241     gcaaatctgc ctgtaaaatc atacaccgga ttttggagta gacacacagg aggctgattg
301     tagtggtggc ttctgggaga agaactgggg ggtagggggc acagataaga gtagacagaa
361     ttttcactct agtaatcttt gtaatttttg aaattctctc taccaggtgt atgaatgacc
421     aatgaaaata tacaataggc caggcgcagt ggctcacgcc tataatccca gcactttggg
481     aggctgaggc gggtggatca catgaggtca ggagtccgag gccagcctga ccaacatggt
541     gaaaccttgt ctctacgaaa aatacaaaca ttagtcaggt agggagcatc acttgagaac
601     aggagttcaa gaccagcctg gacaacaaag caagacctct gcctctacaa aaaaaaaaaa
661     aaaaaaaaaa aattgctggg catggtggaa catgcctgtg gcctcagcta cttaggtggc
721     tgcagcagag gatcatctga ggccaggaat tcaagactac agtgaactat aatcgttaca
781     ctgcactaca gactggtaac agggtgagat cctgtctcaa aaacaacagc aacaaaataa
841     acgattaaaa gacctttttaa agttgcaaaa tacatagagt cttaaacatg catccacagt
901     tatttattta tttatttaga aacggagttt cactcttgtt gcccaggctg gagtgcaatg
961     gtgcggtatc agctcactgc aacctccgcc tcccaagtta aaggaattct gcctcagcct
1021    tccaagtagc tggaattaca ggcatgcgcc accatgctcg gctaattttg tattttttagt
1081    aaagatgggg ttttggcata ttggccagga tggtttcgaa cccctgacct caggtgatcc
1141    acccgcctcg gactcccaaa gtgctaggat tataggcatg agccaccacg cccggccgca
1201    ttcagttatt cttgcaggga taaaatacac aatgaaatac actatacttt ttgttttctt
1261    tctttctttt tttttttttt ttttgagaca gagtctcact cgtcgcatgg gctggagtgc
1321    ggtgcgggat ctcggctcac tgcaacctct gcctcctggg ttgaagcgat tctcctgcgt
1381    cagcctcccg agtagctggg attacaggtg cccgccacta cgcccagcta attttttttgt
1441    atttttagta gagataaggt ttcaccatgt tggccaggct ggtctcgaac tcctgactcg
1501    tgattcgccc accttggcct cccaaagtgc tgggattaca ggcgtgagcc accgcacccg
1561    gccacatttt ttttttttttt tttttgagac aggatcttag tctgtcaccc aggctggagt
1621    acagtggcat gaacatggct cactgcagcc tcaatctctt gggttcaggt gatccttctg
1681    ccttagcctc cccattagct gggaccacag gcatatacca tcacacctag ctaattttta
1741    aattttttggt agaggccagg cgcggtggct cacgcctgta atcccagcac tttgggaggc
1801    cgagtcgggt ggatcacctg aggtcgggag ttcgagacca gcctggccaa aatggtgaaa
1861    ccctgtctct actaaaaata aaaataaaa ataaaaatta gctgggcgta gtggcgggcg
1921    cctgtaatcc cagctactcg ggaggctgag gcaggagaat cgcttgaacc caggaggcag
1981    aggttgcagt gagccaagat cgcgctactg cactccagcc tgggcaacag agtgagattc
2041    tgtctcaaaa aaaaaataat aataatgcta tttattgact ttacaccttg taccaggcat
2101    gggaagcttt gcctccatta cgtcactgaa tctcataacc tccttttcca gcagaggaaa
2161    atgaggttgg ttcacagacc acgttgtcag ctgtgctctg tccagaacgc actggcctcc
2221    aagtagacag ccctggactg gtagggaagc cggctatgat ccggtggcgc cccctggagg
2281    tctatcggga acatggtaaa gaacctaaaa atgggtgggc cacagtagct catgcctgta
2341    atcccagcac tttgggggac caatgcggga gaattgcttg agcccaggag ttcaagacca
2401    gcctgggcaa cattgggaga cccacccccc gccatctcta caaaaaaaaa attaggccgg
2461    gcgcggtggc tcaggcctgt aatcccagca ctttgggagg ccgaggcggg tggatcacct
2521    gaggtcagga gttcaagacc agcctggcca acgtggtgcc acactgtctc taataaaaac
2581    acgaaaatta gggccgggct cggtggctca cgcctgtaat cccagcactt tgggaagccg
2641    aggcgggcgg atcacgaggt caggagattg agaccatcct ggctaacacg gtgaaacccc
2701    ctctctacta aaaatacaaa agttagcca ggtgtggtgg cgggcgcctg tagtcccagc
2761    tactcggtaa gctgaggcag ggaatcgctt gaacccggga ggcgagatg tgcgatctca
2821    caccactgca ctccggcctg ggcgacagag cgatactcca tctcaaaata caaatacaaa
2881    ataaaaaat acaatacaaa aatgacgcgg gcttgcgtac ctgtagacca gctactcagg
2941    agacagaggc aggagaatcc cttgagctct ggaggtcgag gctgcagtaa gccatgatct
3001    tgcccattgc actccagcct gggcgacaga ggaagacctt gtctctaaaa accaaaacaa
3061    agaaactaaa aataagcatt cggatttgtt aggggcgac aagggaggca ctccaggatc
3121    tgtggactcc ccactttgtt ctgtccttgg agagccctgg aaggtctgag aggggacggg
3181    acctggttta aggggtagg ggagaggacc ctggtctagg gggtaaggga cacaaatacc
3241    taatctgagg ggtttcgggg ggacatggcc ctgccctggg gaatctaaac tgggaggcat
3301    ggtctggcag gcccaatcct gaaggctttc tgagggcaat aaggccctgc ctttaaacaa
3361    atgaaaaaac gccaggcacg gtggctcacg cctgtaatcc cagcactttg gaaggctgag
3421    gcgggaggat cacgaggtca ggagatcgag accatcctgg ctaacgcggt gatacccgtc
```

FIGURE 1-B

```
3481    tctactaaaa  atacaaaaaa  ttagccaggc  gtggtggcgg  gcgcctgcag  tcccagctac
3541    tcgggaggct  gaggcaggag  aatggcgtga  acccaggagg  cggagcttgc  agtgagccga
3601    gatcgcgcca  ctgcactcca  gcctgggcaa  cagagcaaga  ctccgtctca  aaaaaaacaa
3661    aaacaaaaac  aaaaacaaaa  acaaaaaaac  aaataaaaaa  acaaaaccac  ataactggat
3721    aaagaaaaaa  ccatctccga  cagccttgga  ggcgggatga  aggcgtggcc  cggtgggcgt
3781    gaccaacagc  aaaagtttaa  gcgttattgg  ctgtattcct  tagttgctca  ctccagaact
3841    gcccacttat  gggcgggggt  cactccttca  ggcttaacag  tcattggctg  aattgggcca
3901    gagaggtctc  attggctgaa  ttcctgcacc  ggctcgtcgg  aggcgggacc  caaagtaggc
3961    taggcctacg  gaagctgggt  cttcttgctg  tgaggtcgcg  ttccccagtg  ttacggaggg
4021    tccttgaggc  aggagtgaaa  attgggtctg  ggggttagtc  ctggggtgga  ggtctgggca
4081    cgccgggtcg  gaccccctcc  atcttcggtt  ttgcacaccc  cgctttccag  cgcggagtcg
4141    cggcgggtag  ggcggcgtcg  cgtgcgtgac  gtcatccagc  ggcgcctcgc  gaggctccag
4201    tggccttgac  ctcccgcggc  gtgggaggct  gcgcggcgat  gctgcagttc  gtccgggccg
4261    gggcgcgggc  ctggcttcgg  cctaccgcca  gccaggtgag  gccaggggct  ggaggcgtgg
4321    tcgaaggatg  aaatttgggg  gtgtccaggg  gtcgtctctc  actttcgccc  aacccttgca
4381    gggcctgagt  tccctggcgg  aagaggcagc  gcgtgcgacc  gagaacccgg  agcaggtggc
4441    gagcgagggt  aaggcaaccg  gggtggctcc  aggagggcg  gcgacagaga  ggtctgaccc
4501    ttgaccctaa  cctctgaccc  ccgcaatcgc  tccaggtctc  ccggagcccg  tgctgcgcaa
4561    agtcgagctc  ccggtaccca  ctcatcgacg  cccagtgcag  gcctgggtcg  agtccttgcg
4621    gggcttcgag  caggagcgcg  tgggcctggc  cgacctgcac  cccgatgttt  tcgccaccgc
4681    gcccaggtga  gcgagggctg  taatggtgaa  ctgagtggca  gagggatgaa  gagcgggatt
4741    tcaggagtca  cgatgacttt  gggcttgtac  ccttgggaaa  gtgctgtatt  tctacagcct
4801    ccgtttctcc  acctgtcaaa  ggggaatgat  gacagtttcc  cctgctgtag  cgctgtgtga
4861    gattgaagcc  tgagaggtga  catcatctaa  gggttaggga  gacagaattc  tggagcccga
4921    ctgattaggt  tcaaatcctg  ccttcccctc  ttgtccctca  gtgtccctat  tttgtcagcg
4981    gtcgggaggt  tgctgtgatg  aataaatgac  ttaattctgg  cacataataa  gttctataga
5041    aatgttgata  atctttgtta  actggttttt  gcaaataaga  gcactaaaaa  gactaaacca
5101    ttcctcggtg  cctggaagag  gctgtttgca  ttttagttac  cctgctgttc  ataacatctc
5161    taagaaaatg  taggggccac  cctgggcgca  gtggctcacg  cctgtaatcc  cagcactttg
5221    ggaggccaag  gcgggcggat  cacgaggtca  ggagatcgag  accatcctgg  ctaacatggt
5281    gaaaccccgt  ctctactaaa  aatacaaaaa  aaaattagcc  gggcgtggtg  gcgggcgtct
5341    gtagtcccag  gtactctgga  ggctgaggca  agagaatggc  gtgaacccgg  gaggcggagc
5401    ttgcagtgag  ccgagatcgc  gccactgcac  tccatcctgg  gcaacactct  gtctcaaaaa
5461    aaaaaaaaa  aaagaaagaa  aagaaaatgt  aggggccagt  tactgtggct  cacatctgta
5521    atcccagcac  attgggaggc  cgaggtgggc  ggatcacttg  aaaccaggag  ttgcagacca
5581    gcctggccaa  catgatgaaa  ccccgtctct  accaaaaata  caaaaattag  ccggacgtct
5641    tagtgcaagc  ctgtagtccc  agctactcag  gaggctgagg  catgagaatc  gcttgcacct
5701    ggggagatgg  aggttgcagt  gagccgtgat  tatactactg  cactccagcc  tgggcgacag
5761    agacagactc  catctcaaaa  aaaaaaacag  gtgaaattga  tttcaataat  gtatttaacc
5821    tgtatttaaa  actatgtcga  aatcacattg  tagcatgggg  cactggccat  gtttcagatg
5881    ttgagtatgt  gactgtatgg  aatggtatag  aactagagag  gaaaaccagt  ccctgaagaa
5941    ggtggcaata  agtgaagtgt  aatagcagga  aaaagtaat  ggtaggaaaa  acaaggaaga
6001    aggggtggct  ttttttttct  gagatgaagt  ttcgctcttg  tcgcccaggc  tggagtgcaa
6061    tggcatgctc  tcagctcact  tcaacctccg  cctcctgggt  tctactaatt  ctcatgcctc
6121    agcctcccga  gtagccagaa  tgacagacat  gtaccaccgt  gccagctaa  tctttgtata
6181    ttttggagag  acatcacttt  gccatgttgc  ccaggctggt  cttactcctt  gcctcaagtg
6241    atccacctgc  cttggcctcc  caaagtgcca  ggattccagg  catgagccac  tgcacctggt
6301    cagggtggct  cttctcttag  aaggtacctt  tcagcagtta  ttggagctgc  tacctgtagg
6361    ctgagaaaga  accatccagg  agaagagtgt  ttcaggcaga  gggaacagca  agtgccaagg
6421    ccctgaggca  gaatttcaag  atggggtcag  tgagggcag  aggcaaatcg  cccagggccc
6481    tggaggcaga  agggagaatc  ctgggttttc  ctatagtggg  gtgggagcgt  ttgaagcaga
6541    gttgggcttc  tcatgtgtcc  ttcctccccg  caggctggac  atactgcacc  aggttgctat
6601    gtggcagaag  aacttcaaga  gaattgtgag  tgcctaaatg  gagcaaggtg  gtgggaagga
6661    gcttcctggg  gaggttgggg  ataggaccca  gaggaagccc  atcgctgggt  tttctctgga
6721    ctgctcggct  ggggcctcat  ctgtctcctg  aactattcac  cgatgggtcc  attttggtt
6781    ctctttttt  tgtttgtttt  tgagatggag  atggagtctc  actctgtcac  ccaggctgga
6841    gtgcagtggc  gcaatcttgg  ttcactgcaa  cctccgcttc  ctgggttcaa  gcgattctcc
6901    tgcctctgcc  tcctgagtag  ctgggattac  aggtgtgcac  caccatgcag  gctaatttt
6961    gtattttag  tagagatgga  gtttcaccat  gttggtcagg  ctggtctcaa  actcctgacc
7021    tcaaggaacc  tacctgcctt  ggcctcccaa  agtgctggga  ttacaggcgt  gagccaccgt
7081    gcccagctca  ttttcagttg  ttttctgatc  actcactgat  gtgggcattg  tggtgggtga
7141    gaggatatag  cagggaccac  gaggacaaaa  caggcaaggt  ccggctgtgt  gcaagtggct
7201    caggcctgta  atcccagcac  tggaagctga  ggtgggtggg  ttgcttgggg  ccaggaaaga
```

FIGURE 1-C

```
7261    ccagcctggg aaacagcaag acccagtctc taccccttcc cccacaaccc caagaaaaag
7321    atgggcaaag tccctattct aatgaaggtc acagtgtcat gggaggagaa gtgaaggtga
7381    gtcagatggt catacgtaat gtgtaattat gagcatgtcc cagagaatgg gacgttcaac
7441    cttgggtcta ctgtagaagc taaccagatc aaggaggcag tggggctagt gtggagataa
7501    caggaacagg gtgtgcaaag gccctgtggc agggaccaca aggaagccag tgttgccaca
7561    gaggccagtg ggagcagtgg ggaggagtct gggttttgtg ccaagaacat tgaagaatcc
7621    attaccagtc agggtcttat ccatccaccc cagaggtctg gccagtcctc cccctgctca
7681    caccttccct ggctccccat caccctagga ataaagtcat cagtctgcta ttctgagttc
7741    ttcctgattt ccttgccctg ctcctctttc ctgattctcc ctgtctgtgt catttcccat
7801    ggccctccct ccttgtggct acaaccacat taaaattgtt caaaaaatag gccggcacgg
7861    tggctcacac ctgtaatctc agcactttgg gaggccaagg caggtggatc acttgaggcc
7921    aggagttcca aaccagccta gtcaacgtgg caaaacccca tctctactga aaatacaaaa
7981    aattagctgg ggccaggtgc ggtggctcac acctgtaatc ccagtacttt gggaggccga
8041    ggcggatgga tcacgaggtc gggagatcga accagcctg accaatatgg tgaaacccca
8101    tctctactaa aaatacaaat attagttggg tgtggcagcg ggcgcctgta gtcccagcta
8161    ctctggaggc tgagacagga gaattgcttg aacctgggag gcggaggttg cagtgagccg
8221    agatcgcgcc actgcactcc agcgtgggcg acagagcgag actccatctc aaaaaaaaaa
8281    attagccggg catggtgaca ggcacccgta atctcagcta ctagggaggc tgaggcagga
8341    gaatcgcttg aatctaggaa tcagaggttg cagtgagcca aggtcacacc acttgcactc
8401    cacagcctgg gtgacagagt gagactgcct caaaaaaaaa aatcaatagt tcagaaaata
8461    ccgagcaccc cctgcgtgcc cggtggcagg gcccctgcct ttgtgaggct ggcatggggc
8521    aggagctgtg acttctttac cctcccctc gctcccaag tactctgtgc ttggccagag
8581    agagcccgtc atcatggtgc ctcctgtctg acttccccgt ggcaggactg atctgcccgg
8641    ctccctgaca cctgcctcgt ggacctgacc cccctcctct ttgtgcctcc agagctatgc
8701    caagaccaag acgagagccg aggtgcgggg cggtggccgg aagccttggc cgcagaaagg
8761    cactgggcgg gcccggcatg gcagcatccg ctctccgctc tggcgaggag gtaacaggac
8821    agggtggagg gggcgggag gggtgggggg gccagggaag ggcctgggtg tttactcaca
8881    cacagctgcg cacatctggc atggtattat gtcagccctg ttccctccac ctcatggaac
8941    cacctgggct ggtgacatcg gaactgaggc ccttggacct cactacccat ataaggggac
9001    agagatctgg gagccatcca ctcctccctc tcgcatgccc tgtctcttca gcctgtggcc
9061    acagcccctc ttgacccac ctcctgtcac cctctcctga cccacacttc ccacagcacc
9121    cagagagctc ttctaaatcg tggaacctga actccggacc tcggcctttg tgtggaacct
9181    gaactcctga ccttgtcatt gtgggccctg gtggctgcac acctttcccc ctcatcccct
9241    cctttccctc tctgaccagg cagagatgac tctctcttgt ttttttcggtt gtgtttgttt
9301    ttaactttt attttcttga atgctaacaa gatgactcag ggtggtgcca gccaccccat
9361    cacctgttta cctggccagc tctcctcacc tttcaggtt ctgggccaca cctcctccag
9421    gaagcccccc ttgatctcct ttccttccac atccccgga gctaccctga tttcttctac
9481    agctgagcct cttttctgcc ctgccggaat gtgaatggca tgagggcagg gaccatgtct
9541    gttgtcttct ctgctgcatt tccaaggccc aggcgagggc agacaccaac acatggtgct
9601    tgcaggggtc tccctgactg ttgttgctcc cagatcatac tgcttgctcc accggagcat
9661    gtgcctgatg ccttcctctc ccgcttgacc tgaaagttcg aacctcctga taacttcagc
9721    attaacagcg tgcttgagtt aagttcacac tctagccact ctatgaatc cacaccataa
9781    ctcatggtgt cctatggggc aggaactgtc cgatctcaag gtggtttgtt ttttttattg
9841    tttgcttttg agacaagatc tcgctctgtt gcccaggctg tagtgcagtg gtgcaatcat
9901    agctcactgc agccttgagc tcctgggctc aagtgatcct ccatcctcag cctcccaaaa
9961    tgctggtgtg agccaccttc gccagccctg tctcagagtg tgacagctgg gaaaactgaa
10021   gcccagtgaa gcaaagtcac tggtcccatg ttgtccctga tccagcctcc cctgaggccc
10081   caccctctct gccttgttcc tggcagcgcc cctctctcg tcaccccatg ccagccactg
10141   cagcagattg ctgacctcca ggctctgcag tggccctcac ctgctcacat gcctctgtcc
10201   ccgcaggagg tgttgcccat ggccccccgg gccccacaag ttactactac atgctgccca
10261   tgaaggtgcg ggcgctgggt ctcaaagtgg cactgaccgt caagctggcc caggtacagc
10321   catgggggg cccagacagc tgctagaggt ggggctgctc tggacccagg gttcaaacca
10381   tccttttcctt ccaccaggac gacctgcaca tcatggactc cctagagctg cccaccggag
10441   acccacagta cctgacagag ctggcgcact accgccgctg gggggactcc gtactcctcg
10501   tggacttgtg agggcacagg gcagagcagg gcaggggggc cctgagctcc gtactctgag
10561   ggttcaaccc ccactccctg gcctctctta cagaacacac gaggagatgc cacagagcat
10621   cgtggaggcc acctctaggc ttaagacctt caacttgatc ccggctgttg tgagcaaag
10681   agcccaggcc cctagagtgc gcatgtgcag gctccgctgt tagaatcaca gcggttcaaa
10741   tccggcatct ggtcgctgag tggcctcagg cagtgaccac gctcccggac ccaaccttca
10801   gcttgcccaa agcaataatc tttcctaaag aagtgcttgg ctggggatgg tggctcacgc
10861   ttgtaatccc agtactttgg gaggccaagg cagtctgggc aatatagtga ggctcccatc
10921   tgtactaaaa ataaaaaagt taggcgtggc gatgtgcacc tgtagtccca gctactcggg
10981   ggctgagcca ggcggatagc ttgagctcag ggggccaagg ctgcagtgag tcatgatcgc
```

FIGURE 1-D

```
11041  accactgcac ccaaacctgg ggagagagct agactcttgt ctcaaaaaaa aaaaaaaaaa
11101  aaaaaaaaaa gctccaaagt cacctctgtc aaagccacag tctgttcctt ccacagccac
11161  aagatggcga catgagccta agtcaagtcc tgtccctcaa cccacgcccc tcgctggctt
11221  ccccacctct ctcaggatga aagccaagt catcaggdtg gcacgtcagg ccctgcacga
11281  tgtgcccegt cacctccctg ccctcccgtc atttgccctg ggtctccccc accagaatgg
11341  gagccaggag tcccagccag gcacaggacc gagcctggct ctcggtcagc aggtgatgag
11401  ctgggagcag ctccttggcc agaggcttac aggcaacaag cggccaggca gggtctggcc
11461  ccgggctgct gggctcacaa agtcacacta gaccacagtg acgatctctg taagcacaaa
11521  gggactccga tgtgggtggg gtgaggagag aggcagcccc ggcctgaccg gccccccgcc
11581  ccgcccccac cccgccccca ggcctaaatg tgcacagcat gctcaagcac cagacgctgg
11641  tcctgacgct gcccaccgtc gccttcctgg aggacaagct gctctggcag gactcacgtt
11701  acagacccct ctacccctcc agcctgccct acagcgactt cccccgaccc ctaccccacg
11761  ctaccaggg cccagcggcc accccgtacc actgttgaWg tgaagcacct cttctgagcc
11821  aggccgagcc cctgccgac ttgggagcct Yaggcccacg cccaccttc gaggaaggtg
11881  tcacctggac ccttcattc cacggaggaa gctgaggcca cagggagcgg ccatcgccat
11941  tgggaagggg cgactccacg gaRagcccag acgggcttct gcatccattc cctctttttg
12001  ttttaaaat aaattgtatt tttgaatcaa ggaggataaa gataacttct cagtgtcatt
12061  tttgataatt gcattgagaa cgatgagctc cttcccaggt tctgggcact gttggggatc
12121  cgccgtctca agaggctcac ggtctggttt aggggaaccc cagggctgtt tgtggaaatt
12181  acaagaattc acttacccgg tgagtcagac tccaggagct cacaggtgcg tgggcgctgg
12241  cacttcctag gagctgactc ctgccacatc cctctcctga gcactgctgc cagccattct
12301  caccctgag aggggtttgca gtcctgtctg cgacagtact tcatgcagcc tgagtgtg
12361  tgcttgattg tacaagtaga tgttgtgtaa acctgagttt tcagagtgac ttcctgtaag
12421  cacagtcaga aaagtaaatg tctctctgta agtgagcaga taagcacatg cttaaaaaca
12481  ccagctgggc gtggtgactc gcacctgtaa ccctagcact ttgggaggtc aaggtggaag
12541  gatcgtttga gctcagagct tccagaccag cctgggcaac atggtgaaac cccatctctg
12601  caaaaatat aaaaattaag tgggcgtgtt ggcgtccacc tgtggtccca gctacttggg
12661  aggctgaggt gggaggatca cctgagccca ggaagcagag gttgcagtga gctgagactg
12721  agccaccaca caccagcctg ggtgacagag tgagacactg tcttaaaacc ccaatatccc
12781  aattttgag tttgctgagg ttgccagcca agttaatttt tcttaacagc cataacagac
12841  tataatatag acaatgtgat cgatttattt aaagtcaacc agctgggcgc ggtggctcac
12901  gcctataatc ccagaatttt aggaggctga gccaggtgga tcaccggaag tcaggagttc
12961  gagaccagcc tggccaagcc gggagtggtg gcgggcacct gtaatcccag ctacttagga
13021  ggctgaggtg ggagaatcgc ttgaacccag gaggcagagg ttgcagtgag ccaagatagc
13081  gccactgcgc tccagcctgg gtgacagagc aagattccat ctataaataa ataaataaat
13141  aaagtcaatc aggactgcct tctgcctgtg tgggcctggc caggctaagc agccacacaa
13201  ccctccctac ctgctgggcc acccctggct gaaaacctct ctggaatgcc tctcttggga
13261  ttgccttcag agattgcaac acattctcca aacaccctca gtggacatag actttgatcc
13321  ttgaagcagc agatttgact aagtaaaaaa gaaaaagcta ttaaaaccag ttggctgggc
13381  gcggtggctc acgcctgtaa tcccagcact ttgggaggcc gaggcaggcg gatcacgagg
13441  tcaggagatc gagactatcc tggctaacac agtgaaaccc catctctacc aaaaatacaa
13501  aaaattagcc gggcgtggtg gtgggcgcct gtagtcccag ctactcagga gactgaggca
13561  ggagaatggt gtgaacccgg gaggtggagc ttgcagtgag ccgagatcgc gccactgcac
13621  tccactccag cctggcgaca gagctagact gtctcaaaaa aaaaaacaga ggcgtgccaa
13681  agctcagcag aaaatgccgc ctcatcactc ttcctcttgc cagtcttgtg ggggcaccaa
13741  ggcctagagt aacacccagc tgttggcctg acagtgcctg gcccagcctg gagagttgca
13801  gccagaagta taaatgtggt tcagtctgcg tcatacctgt caggaaacat ggtgagacca
13861  actgctgccc agacggattt tcaaaagaaa tgggtcagaa cgtattcccc cacactggaa
13921  tccctcagcc agattgagga taaaaacagg catcagaaaa aaatgataca ggcaggcctg
13981  gtggctcatg cctgtaatcc cagcactttg ggaggctgag gcgggaggat cgcctgagca
14041  caggagtttg agaccagcct gggcaacaca gtgagaacct atctctacta aaaatagaac
14101  aattagccag gcacggtggt gtggctgtgg tcccagctac tctggaggct gaggtgggag
14161  gatcacttga gccctagggg tagaggctgc agtgagcgga gatcacccca ctgcaatcca
14221  gcctgggcaa cagatcaaga ccctgtctca aaaaaaaaa aaagaaaaga aaacaaaaga
14281  aaaatagat acactgacta gaatgtgctt taaaataatt ggcatagttg ggtatggtgg
14341  catgcacctg cagtctcacc tacttggaaa gctgtggcca ggagtttgag accagcctgg
14401  gcaacacagc aagacctcat ctctataaaa aataggcggg gagcagtggc tcacgcctgt
14461  aatcccagca ctttgggagg ccaaggcagg cggatcacta gaggacagga gttcaagacc
14521  agcctggcca acatggtgaa accccatctc tactaaaaat acaaaaattg gcaggatgtg
14581  gtggcgggtg cctataatcc cagctacttg ggaggctgag gcaggagaat cgcttgaacc
14641  tgggaggcag aggttgcagt gagccgaggt catgacactg ccctcaaacc tgggtgacag
14701  agcaagactc ggtctcgaaa aaaaaataa tgaatgaatg aattaattca ttaattaaat
14761  agggggggta tatgagtttg ttagggctgc cgtaggagtg ccacaaactg caggggttgg
```

FIGURE 1-E

```
14821  ggggttagt caacagaaat ttattctgtc ctgtttctgg aggctggaag tccaaggtga
14881  agaacagggt tagctccttc taagggaaaa tctgttccag atccctctcc tagcgtctgg
14941  tggtttgctt tgctgactat ctttgacatt ccttggcttg tagccacact gcttcagtct
15001  ccaccttcat ctttacatga tgttgtccct gtgggtatgt gtctgtttct gtgtctaaat
15061  ttctcctttt tattttttc ttttttctct atctttttt ttagacggag tcgcgctctg
15121  ttgcccaggc tggagtgcag tggctcgatc tcggctcact gcaacttctg cctcctggt
15181  tcaagcgatt ctcctgcctc agcctcccaa gtagctggga ttacaggcgc ccaccaccat
15241  gcctggctaa ttttttgtgtt tttagtagag aagggttttc gccatattgg ccaggctggt
15301  aacctcaggt gatccacccg ctttggcctc ccaaagtact gggattacaa gcgtgagcca
15361  ccgaacctgg cctattttt catttatttt tagacagagt tttgctcttc ttgtccaggc
15421  tagagtacaa tggcgcaatc tcggctaatc tcaacctccg cctccgggt tcaggcgatt
15481  ctcctgcctc agcctcccaa gtagctggga ttacaggcat acgccacaat gcctggctaa
15541  ttctgttttg ttagcagaga tggggtttca ccatgttggt caggctggtc tcgaactccc
15601  gacctcaggt gatccaccca cctcagcctc ccaaagtgct gagattacag acacgagcca
15661  ctgagcctgg ccctctcctt tttatttta aatatatt tgtggacggc agcagtggct
15721  cacacctgta atcccagcac tttgggaggc cgaggcgggt ggatcacaag gtcaggaact
15781  cgagaccagc ctggccaata tggtgaagcc ccatctctac taaaaatata aaaattagcc
15841  aggcatggcc gggcgcggtg gctcacgcct gtaatcccag cactttggga ggccgaggcg
15901  ggcggatcac gaggtcagga gatcgagacc atcctggtta atacggtgaa accccgtctc
15961  tactaaaaat acaaaaaaaa aattagctgg gcgaggtggc aggtgcctgt agtcccagct
16021  actcgggagg ctgaggcatg agaatggcgt gaacccggga ggcggagctt gcagtgagct
16081  gagatcgcgc cactgcactc cagcctgggt gacagagtga gactccatct caaaaaaaaa
16141  aaaaaaaat ttagccaggc gtggtgtcag aagcctgtag tcgcaactac ttgggaggct
16201  gaggcaggag aatcacttga acccaggagg tggaggttgc agtgagccga ccacatca
16261  cggcacatct aaaaaaaaaa aaagttttct gtttttgttt ttgcaaaac tactgaaata
16321  aatacagtga gatatttatt tataaatgag aacgaattaa taatgagccg taggctgggt
16381  gtggtggctc atgcctataa tcccagcatt tgggggggcc aaggcaggtg gaacacttga
16441  ggtcaagagt tcgagaccag gctgaccaat atagtggaac cccatctcta ctaaaaatac
16501  aaaagaatta gccgggcatg gtgccgggcg cctgtaatct cagctatggg aggctgaggt
16561  aggagaatcg cttaaaccct ggaggcggag gttgcagtga ggcgatatca cgccactgca
16621  ctccagcctg ggggacagag cgagactcca tctctaaata aataataag gagctgtatt
16681  tcaaaatttg gagaaggtga cactgagagt actgaataca cagtttttg ttttttggt
16741  ttttttgag acagagtctc gctctgtcac ccaggctgga gtgcagtggt gcaacctcgg
16801  ctcactgcaa tctctgcctc ccgggttcaag caaatctcct gcctcagcct cccgcgtagc
16861  tgggattaca ggcacgcatc cccatgcctg gctaattttt gtatttttag tagagacggg
16921  atttcaccat attggtcagg ctgatctcaa actcctgacc tcgtgatctg cctgcctcgg
16981  cctcccaaag tgctgggatt acaggcgtga gccaccgagc ctggcccaa aaatattta
17041  tcaaaactat gttaatgctg gccgggtgcg gtggctcatg cctgtaatcc cagcactttg
17101  ggaggccgag gcaggtggaa cacgaggtca ggagattgag accatcctgg ctaacacggt
17161  gaaaccccgt ctctactaaa aatacaaaaa aattagccgg gcgcggtggt gggtgcctgt
17221  agtcccagct actcaggagg ctgaagcagg agaatggcag gaaccgggga ggcagaggtt
17281  gtagtgagct gagatcgcgc cattgcactc cagcctgggc gacagagcga gaatccgtct
17341  cgaaaaaaaa aaaaaatac acacacac acaaaaactg tgttaatgct taactacaca
17401  aaaatgataa tcagataaat atgcatttat ttagagaact gcatgttggt cagtccagtc
17461  cctgcagagg gaattcccag catgacctca ttcacttgtg aagacagagc aatccttgtg
17521  tttatttt ttaaagtgga tctcactctg ttgcccagac tggagtgcag tggcatgatc
17581  tcagccctct gccacctcca ccttccgggt tcaagagatt ctcatgcctc agcctcctga
17641  gtagctgaga ttacaggctt gtgcctccat gcccagctaa tttttttatt tttactagag
17701  atgaggtttc accagtttgg gcaggccggt ctcaaactcc tgacctcaag tgatccaccc
17761  acctcggcct cccgaagtgc tgggatgaca ggtgcctggt cagcaactgt tgtttagaca
17821  tacacatttt atctgctcgt ccagcatggt cagccctcca cttttaaat tttattttat
17881  ttattttt gagacagagt ctcactctgt tgtccaggtt ggagtccagt ggcgtgattt
17941  cggctcactg caacctctac ttcccaggtt cgagcaattc tcctgcctca gcttccgag
18001  tagctgggat tacaggcccg cgtccccaca cctagctaat ttttgtattt ttagtagaga
18061  cagggtttca ccatgttggc caggctggtc tcgaactcct gacctcaggt gattctcctg
18121  ccttggcctc ccaaagtgct gagattacag gtgtgagcca ctgcacacgg ccttaaattt
18181  tatttattat ttatttattt atttatttag agacttagtc tcactctgtt gcccaggctg
18241  gagtgcagtg gcatggtctc ggctcactgc actccacctc ctgggttcac gccattctcc
18301  tgcctcagcc tcccgagtag ctgggactac aggcgcccac caccactccc ggctaattt
18361  tgtatttta gtagagatgg ggtttcactg tgttagccag gatagtctcg atctcctgac
18421  ctcgtgatcc gcctgcctcg gcctcccaaa gtgctggat tacttatttt gtttttgta
18481  gagacaggtt ctcactgtgt tgcccaggct ggtcttgaac tcctgatctc aagtgatctt
18541  cccacctcag tctctcaaag ggctgggatt acaggggtga gccactgcac cccaccttcc
```

FIGURE 1-F

```
18601   ctctactttt tgacggtttc cttctgctat gaatgtgcat gtccagttgt ctgcttctta
18661   gaactgatat ttaccttcct catccatcag ccattggagg aggactggga ccgctcagat
18721   tattgatctg acccattctt tcggcagggt ttcctggtgg ctgtcttcca tcaccaaaac
18781   tggaatcaga agagtttcca tagcccttt tttttcccca catctttgct gaagcagagt
18841   tttgaaaaac aaaaccacaa actaagctat tccccagaag aaatctgtaa tcaaagataa
18901   gctctgccgg gcacagtggc tcacgccttt tggaggccaa ggcgggcgga tcacctgagg
18961   tcaggagttc tagacctgcc aggccaacat ggtaaaacct catctctact aaaaatacaa
19021   aaattagcta gatgtggtgg tgggtacctg tagtctcagc tacctgggag gctgaggcaa
19081   gagaatcgct tgaacctggg aagtagaggt tgcagtgagc cgagattgca ccactgcact
19141   ccagcctggg cgacggagtg agacgacctc acaaaaattt acataaataa aatgaaaagt
19201   aaaataaaaa tacaaaagtt ggccgggtgc gtttgctcac gcctgtaatc ccagcacttt
19261   gggagggtga ggcaggcaga taatgaggta agaagatcga gaccatcctg gctaacacgg
19321   tgaaaccctg tctctactaa aaatacaaaa aattagctgt gcgtggtgac acgcacctgt
19381   agtcccagct atttgggagg ctgaggcagg agaatcactt gaacctggga ggtggaggtt
19441   gcagtgagcc gagatcgcac cactgcactc cagcctgggc cacagagtga gactccatct
19501   tgaaaaaaaa aaaaaataca aaagttagcc aggggtgttg gtgggtgcct gtaatcccag
19561   ctatttggga ggctaaggca gaagaatttc ttgaacctag gaaacggagg ttgcagtgag
19621   ccgagatcac acctctgtac tccagcctgg acaacagagc gagactttgt ctcaaaaaaa
19681   aaaaaaaaaa aaaaactaaa taggccggga gcagtggctc atgcctataa tcccagccct
19741   ttgggaggcc aaggcaggtg gatcacttga ggtcaggagt ttgagaccag gctggccaac
19801   atggtgtaac cccgtctcta ctaaaaacac aaaaattagc cgggtctggt ggcgtatgtc
19861   tgtaatccca gctactcggg aggctgaggc aggagaatca cttaaacctg ggaggcaggg
19921   gttgcagtga gctgagatcg tgccactgca ctctagccag ggtgacagag tgaaactctg
19981   tctcaaaaaa ttaaaaaaga aattcagcaa gtaatgagtt aaggaattcg aatattaagg
20041   cgagtgacaa ggaacgccca ggatgtggcc caggatggag tagggggac actcatttag
20101   gagaaagctc aggccacaag acaggaggag ccagccttgt tggggttgaa gggaagagca
20161   ttccaggctg agggaactgc aaggcgtttg catgggacac tatgggatgg cttctgccct
20221   tggtgggcag cctctggtct gaggccattc tttgcctgc ctgactgtct ggcaaccggg
20281   aggaagccct gcccttcctg gagacagaaa caaggtcta ggaaatatct gcttcccttt
20341   tccttgaaaa acgcttaagg gaacggagga ctgggaggtg ccgtctctct ctgccagcct
20401   gccccctacc atagccatcc cactcccatc tcagaaagtg acccgccatc ctccaaaagg
20461   ctcggaccct gatcaaggag tcatcccct tgtcccagca cctccagttg gcccagcctc
20521   caaacggat gtcaaattca gcccttttctc caaggacact gccagtcca ggccccacta
20581   tcattcatct ggactagaac agtcacctcc tctcccatct cctggctgca gctcttgaag
20641   cctcaactgg gcccctgtga acacttgagt tagggcaagg tccttcctct gctcagaacc
20701   ctctatacct cccacctcgc tgggcataaa agccaaagtc ctggccaggc acggtggctc
20761   acatctgtta tcccagcact ttgggaggcc aaggggggcg gatcactaga ggtcaggagt
20821   tagagaccaa catggtgaaa ccccatctct actaaaaata caaaaattag ctaggcgtgg
20881   tgacgcaccc ctgtagtacc agctactcgg taggctgagg tgggagaatc gcttgaacct
20941   gggaggcaga gtttgcagtg agccgagatc acaccactgt gctccagcct gggtgacaga
21001   acgagactgg ggttcagaaa caaacaaaca aaacaacaaa gtcctcctca ggtgacagga
21061   acttgcacct atctgccctg tcatctccct gcccgctcct ctcctcgaat ctctcctttg
21121   ctaagcctgc tccagccaca ctgttctcct ggctgttcct ttttttttt tttttttttt
21181   tttttgagt ctcactctca cccaggctgg agtgcagtgc ctctatcttg gctcactgca
21241   acctccgcct gccgggttca agagattctc ctgcatcagc ctcccaagta ggtggaatta
21301   caggtgtgca ccaccacgc cggctaattt ttgtattttg catagagatg gggtctccc
21361   tatgttgccc aggctggtct tgaactcctg ggctcaagtg atcctcccat ctcggcctcc
21421   caaaatgctg ggattacagg tgggagccgc gcccaggtgg attttttgtct gactctgttc
21481   attcctgtgt ccccagtacc tggaaggacg ccaagcacac agtaggcgct taaaaaacat
21541   tgagccacat gttgagaaaa gaacggcacc attgtggctg caagtgggac ttgggccgcg
21601   cgggggagct cgcgcacctc gggccggggc aagagctcag tggaacccgc ccaggaaga
21661   acccgtggcg caggattttc ccaggccttc tgaggaccag gggcgtcccc cgtcccaccc
21721   tgtgactttg ctcaggccgt tccggggcgg gaattcagaa ctcctcagcc ccccaagaaa
21781   aaaatatccc cgtggaaatt ccttgggaat gaccgaggcg ggggaaatat gcgtctctgg
21841   atggccagtg actcgcagcc cccttccccg ataggaaggg cctgcgcgtc cggggaccct
21901   tcgcttcccc ttctgctgcg cgacctcccc ggcccctcgg agatctccat ggcgacgccg
21961   cgcgcgcccc acaacaggaa agcttaggc ggcgcggctt ggtgctcgga gacttaagag
22021   tacccagcct cgacgtggtg gatgtcgagt cttgggtca cacgcacagg cggtggccaa
22081   gcaaacaccc gctcatattt agtgcatgag cctgggttcg agttgccgga gcctcgcgcg
22141   tagggcaggg gttcgagcgc ccctccctcc tgcctcgcct ctgcgctgg gggctgctgc
22201   ctcagtttcc cagcgacagg cagggatttc gagcgtcccc ctccccctccc tcgtcaagat
22261   ccaagctagc tgcctcagtt tccccgcgga gcctgggacg ccagcggagg ggctcggcgc
22321   gtagggatca cgcagcttcc ttcctttttc tgggagctgt aaagacgcct ccgcggccaa
```

FIGURE 1-G

```
22381   ggccgaaagg ggaagcgagg aggccgccgg ggtgagtgcc ctcgggtgta gagagaggac
22441   gccgatttcc ccggacgtgg tgagaccgcg cttcgtcact cccacggtta gcggtcgccg
22501   ggaggtgcct ggctctgctc tggccgcttc tcgagaaatg cccgtgtcag ctaggtgtgg
22561   acgtgaccta gggggagggg catccctcag tggagggagc ccggggagga ttcctgggcc
22621   cccacccagg caggggctc atccactcga ttaaagaggc ctgcgtaagc tggagaggga
22681   ggacttgagt tcggacccc tcgcagcctg gagtctcagt ttaccgcttt gtgaaatgga
22741   cacaataaca gtctccactc tccggggaag ttggcagtat ttaaaagtac ttaataaacc
22801   gcttagcgcg gtgtagaccg tgattcaagc ttagcctggc cgggaaacgg gaggcgtgga
22861   ggccgggagc agccccggg gtcatcgccc tgccaccgcc gcccgattgc tttagcttgg
22921   aaattccgga gctgaagcgg ccagcgaggg aggatgaccc tctcggcccg ggcaccctgt
22981   cagtccggaa ataactgcag catttgttcc ggaggggaag gcgcgaggtt tccgggaaag
23041   cagcaccgcc ccttggcccc caggtggcta gcgctataaa ggatcacgcg ccccagtcga
23101   cgctgagctc ctctgctact cagagttgca acctcagcct cgctatggct cccagcagcc
23161   cccggcccgc gctgcccgca ctcctggtcc tgctcggggc tctgttccca ggtgagtcgg
23221   ggtggggatt gccgtcgggc cagttctccg aagcccgcgg aggaccggct cccggtccag
23281   gtcatgcatg cttaggtagc tgtttatggg aaggaggggc tagagacagc gattgaaagg
23341   caacagccag taggttcgaa tccagaccct gcatacctcc acgtgtggcc ttgggctata
23401   gattgcagct ttaaaaaagg gtaggggtt ggagatggag ggaggggcg ggcctcgttt
23461   tgttgcccag gccggtcttg aactccgggg gtctagcctt acctcctgcc tcagcctccc
23521   gagtagctgg gatgagaggt gtgaaccacc gccttgcttg gctagattgc gtctcttaca
23581   gtttctcagc tgtaaaacgg gaaacgttat agcggccacc tggcagggta tcttggccca
23641   gcgcagcacc tggccccagg actcgatcat gatggtttgg gaacttggct ctgtgccaac
23701   ccaacaaggc ttaagggacc cccaccccc tcaagatgta tattctgttc ctcatcctct
23761   ctgccctgg ggaagtccag ggctgcttct acttggggga attccagagc tgacttatcc
23821   gtggcccaaa gctgagaagt gggacgcccc agcacaccct cccccagctc cagcccagct
23881   agggaagagg gaaggggtca gagggtcttt catggtggtg taagtttggg gaaccaggag
23941   ggtgggagat tgacagcttg gttaacagct caacaaagcc tgagatccag gccagcacgg
24001   tagttcatgc cagtaatccc aacacttag gagcccagg cgggcgaatc acttaaggtc
24061   aggagtttga gaccagcctg gccaacatgg caacatcccg tctctactaa aaatacaaaa
24121   attagctggc atggtggtgg gcgcctgtga tcccagctgc tcgggaggct gagggaggaa
24181   aatcccttaa gcccacgagg ctgaggttgc agtgaaccaa gattgtgcca ctgcactcca
24241   gcctgggaga catagcgaga ttctgtctca aaaaacaaag cRttctgatc cggactcaga
24301   cccagatcgc actgctttct agctgagtaa ccatttctct ctatgaaatg ggaatggtcc
24361   cagaatctcc cttggagaat gtatgagcc agtgtcctca cacccccatc caagatagaa
24421   caaatctgag acaggaatct ttgagtgagg cagtgctggg ctcagacatt ttttcccacc
24481   ttcggaggca gcagaatctg agggacctga tccaaataag ccccttcttt cttctttttc
24541   ttttcttttt ttttttttt ttttttgag acggagtctc actcgtcgc ccaggctgga
24601   gtgcagtggc gtgatctcgg ctcactgcaa cctctgcctc caggttcaa acgattctcc
24661   tgcctcagcc tccctgagta gctgggacta caggcatgtg ccatcacacc cggctaatca
24721   ctgtgttagc caggatggtc tcgatttcct gacctcatga tctgcccacc ctgcctccca
24781   aagtgctggg attacatgcg tgagccacag tgcccacccc gtaagcccct tctttcttac
24841   ctgcaaggta gccagttgct acccatcctg tgctgagtta cttgtattag caaggggatgg
24901   ggtggctata ctcacccacc ttacagatgg ggaaattgag gcccaaagag ggggaaacta
24961   cgtgtctcag ggagtgagga gccagtctga ttcctggagg gctgactgtc tccacctgac
25021   ttcttaggag ggaggagggc accaacttca cattaaaatc tggttggaca cagtggctca
25081   cacctgtaat cctggcattt tgggaggctt aggcgggagg atcacttgag gccaggagtt
25141   tgagaccagc cttagcaaca tagtgagacc ccatctctac aaaaatgttt tcagggcca
25201   ggcgcggtgg ctcacaccta taatcccagc actttgggag gctgaggcgg gcggattacc
25261   tgaggtcagg agtttgagac cagcctgacc aacatggaga aacccctgtct ctactaaaag
25321   tacaaaatta cccgggcgtg gtggcgcatg cctgtaatcc cagctactcg ggaggctgag
25381   gcaggagaat cgcttgaacc tgggaggcgg aggttgcggt gaactgagat cgtgccattg
25441   cactccagcc tgggcaacaa gagctaaact ccgtctcaaa aaaaaaaaa tgttttcaa
25501   atattagccg ggtatggtgg tgtcctgtag tcccagctac ttgggaggct gagatgggag
25561   gatcacttga gcccaggagt tcaaggttac agtgagctat gattgtgcca ctgtattcca
25621   gcctgggtaa cagagggaga cccgttttaaa aaaaaaaag tgatggctaa agtccttcca
25681   tggctcccta ttgccctcag tataaagaac acatgtggct gggcgtggtg gttcacgcct
25741   gtaatcccag cactttggga ggctgaggcg gcggatcac ttgaggccag gagtttgaga
25801   gcaggctggc cgacgtggcg aaaccccgtc tctattaaaa atacaaaaat tagctgggcg
25861   tggtggtgct tgcctgtaat cccagatact ctggaggctg aggcaggaga atcacttgaa
25921   cccgggaggc aaaggttgca gtgagctgag attgcgccac tgcactccag tctgagtgac
25981   aaagcgagac tccatctcaa aaaaaaaaa aataaaagaa cacatcttta gcatggcctt
26041   cagtgctcac gggatcttcc tgaattaatc tcccctctt catccttgct cactcagctc
26101   cagccaccct gccccgggac atctgtactt gcctggaact tatttccctt ttctccggac
```

FIGURE 1-H

```
26161  agccagccct ttctcgtcat ttagatctct gctgaaacat taccctgtca ccaaagcact
26221  gtctattcta tcaccctgtt ttgttttttgt caaagctcat attaacatca gttattaatt
26281  atcttgtttg ctcataatttt tttttttttt tttttggag acagagtctc gttctgttgc
26341  tcaggctgga gtgcagtggc acaatcttgg ctcactgtaa cctccacctc ccaggttcaa
26401  gtgattcttg tgcctcagcc tcccaaatag ctaggactac aggcacgtcc caccatgccc
26461  agctaatttt tgtattttta gtggagacgg ggctttgtca tgttggccag gctgatctca
26521  aattcctgac ctcaagtgat ctgcccgcct tggcctccca aagtgctggg attacaggcg
26581  tgagccacca cacccggcct gctcatgaat tttctcttta acttccacat cgaaggcaaa
26641  gtattgtctt gttaaggctg tgcctccagc acccagcaca ggctgggcgc acattcsctt
26701  gatgaacctg atttgtaatg cctgtcgcct cttccctcgt ttcttctagg acctggcaat
26761  gcccagacat ctgtgtcccc ctcaaaagtc atcctgcccc ggggaggctc cgtgctggtg
26821  acatgcagca cctcctgtga ccagcccaWg ttgttgggca tagagacccc gttgcctaaa
26881  aaggagttgc tcctgcctgg gaacaaccgg aaggtgtatg aactgagcaa tgtgcaagaa
26941  gatagccaac caatgtgcta ttcaaactgc cctgatgggc agtcaacagc taaaaccttc
27001  ctcaccgtgt actgtgagta actgagcccg gagggctgga ctaggcagac ccggtgggag
27061  agacgtgcag gggcacctgc agaggcctgg gggaatcttt gccacttgct cgtagggtca
27121  aggaggggct ccttgcaggg caggtgggga catccttgga aagtccctct gtgaatttct
27181  ttgggtacaa ttaaagtatt tacaggctgg gtgcggtggc tcatgcctgt aatcccagca
27241  cttttgagagg ctgaggctgg cggatcacct gagatcagga gtttaagttt cgccaacatg
27301  gcgaaaccct gtctctgctg aaaatacaaa aatcagccgg gcatggtgtc aagcgcctgt
27361  aatcccagct acttggaagg ctgaggcagg agaacgcttg aacctgagag cagagattg
27421  cagtgagccg cgatcgtgcc agtgcactcc agtctggata acagagcaag attccatctc
27481  aagaaaaaaa aaatgccatc tctctatgcc tcactctttg aacatatgac acggtcctgc
27541  ttcagacact ttaataaaag atgcaaatta gccaagtgt ggtggcttgt acctataatc
27601  ccaactactc cagaggctga ggcagaagga tggtttgagc ccaggagttt gagaccagcc
27661  tgggcaacag agtgagaccc tgtttctttc tttttttttt ttttttttt gagacggagt
27721  ctcactctgt cgcccaggct ggagtgcagt ggtgtgatct cggctcactg caagctccgc
27781  ctcccgggtt cacgccattc tcctgcctca gcctcccgag tagctgggac tacaggcgcc
27841  tgccaccatg cccggctcat ttttttgtat ttttagtaga cggggttt cactgtgtta
27901  gccaggatgg tctcaatctc ctgacctagt ggtccgcccg cctcggcctc ccaaagtgct
27961  gggattacag gtgtaagcca ctgtgcccat ccaagaccct gtttctaccg gaaaaaaaaa
28021  gtaaataatt tagctgggca tcgtggtgtg cacctgtaat cccagctgct cctgaggctg
28081  tgatgggagg attgctttaa cccagggtt cgaatcctag gagttcgaat ccatcctagg
28141  caacatagca aaaccccatt tttatttaaa aaaaaaaaaa aagatatgag ttaaaactag
28201  ccctgggatg gcattttca catattggta acaaacaaaa gaattgatgg ccgggcgcag
28261  tggctcacgc ctgtaatccc agcactttgg gaggccgagg cgggcggatc acaaggtcag
28321  gagatcgaga ccatcctggc taacatggtg aaaccccgtc tctactaaaa ctacaaaaaa
28381  ttagccgggc atggtggcag gcgcctgtgg tcccagctac tcaggaggct gaggcaggag
28441  aatggcatga acccgggagg cagagcttgc agtgagccaa gatcgtgcca ctgcactcca
28501  gcctgggcga cagagcaaga ctccatctca aaaaaaaaaa aaaaaaaag aattgataac
28561  agctgtgctg ccaaggctat tggaacgtag gaggtcctag gacagtgctg ttgggagcat
28621  aaataagccc aaccctgtgg cgggaaattg ggcatcagtt ctcaaaatgt catgggctgg
28681  gcacggtggc tcacgcctgt aatcccagca ctttgggagg ctgagggagg cggatcactt
28741  gaggtcagga gttcgagacc agcctgacca ccatggagaa acccccgtctc tattaaaaat
28801  acaaaaaaaa ctagccaggc atagtggcac ataccgtaa tcccagctac tcgggaggct
28861  gaggcaggag aatctcttga aactggggagg cagaggttgc ggtgagctga gattcgcca
28921  ctgcactcca gcttgggcaa caagagcaaa actccatctc aaaaaaaaaa aaaaagaaa
28981  taaagaagg tatgttgaat atgagtggta tgccaccctc acattaggga agggcagttt
29041  cggggaggct gtatttatgt ataaaatagc cctaaaagga agtgggagaa atgacaatat
29101  tagctggcta tgagaagaga ggctgggagg ctgtgggaga gggcttgggt gtggagaatt
29161  cttttgttt ttcctttt ttgagacaga gtttcactct tgttgcccag gctggagtgc
29221  aatggcacga tctcagctca ccgcaacctt cacctcctga gtttaagtga ttctccggcc
29281  tcagcctccc gactagctgg gattacaggc atgggccact acgcctggca aattttgtat
29341  ttttagtaga cagggtttt ctccatgttg gtcaggctgg tcttgaactc tgacctcagg
29401  tgatccgccc gcctcggcct cccaaagtgc tgggattaca acgtgagcca cttttgcctgg
29461  ctgagaattc ttttttttgtt gttgtctttt tgagatggag ttttgctgtg tccccagcct
29521  ggagtgcaat ggtgtaatct cagctcactg caacctctcc ctcccgggtt caagcaattc
29581  tcctgcctca gcctcccaag tagctggaat tacaggcgcc cagcaccacg ccYggctaat
29641  ttttgtattt ttagtagaga cgggattttca tcatgttggc caggctggtc ttgatctcct
29701  gaccttgtga tctgcccgcc tcggcctcca aaagtgctgg gattacaggc gtgagccact
29761  gccccagcc gagaatttct ctttgcgtcc ttcctacttt ggggacttcg aatggtggga
29821  aagagttatc aaggccaaaa taaggaattc aaatgaaaac aaaacaaaat caaagaagaa
29881  aaaacagaag agcactgggc aggctaggca cgtggctcat gcctataatc ccagtgattt
```

FIGURE 1-I

```
29941   agaaggccga agtagaagga tcgcttggag gccaggagtt ggacaccagc ctgggcaaca
30001   tagcaagacc ccatatctac aaaaaataaa aaacctaacc aagcgtgctg gcatactagt
30061   agtcccagct actcaggagg ctgaggtggg aggatcacct gagcctggga ggtccaggct
30121   gtagtgagcc gtgatgacac cactgcactc cagcctgggt gacagagaaa gacctgtct
30181   ctaaaaaata aaaactggcc aagtagcttt gggattagcc ttgggttcca gtcccagcaa
30241   ggcctttaat agcttgggac atgacttctg catttacttt gcaatcaggt gagacctcct
30301   ctgatgggga aaatgacacg gtgagtgaca aaggatgttc tcctatcatt gtgtcagggc
30361   aaggaagcct ctgggtaaat gatcaaatga tcagtttgc ttctgatttg gagggtgggt
30421   gagcagatgc tgaccttccc aggtgaggga agtcccgaa cattcccagc agcttctgga
30481   aaccccaggg aaacctcttt gaaggtcttt tctgcatctc tgcctgatag gtcttttttt
30541   tttttttttt tttttttttt tttttgacac acagtcttgc tctgtcgccc aggctggatc
30601   actgcaacct ccatctcccg ggttcaagca gttctcctgc ctcatcctct ccagtagctg
30661   ggattacagg cacctggcac cacgcctggc taatttttgt attttagta gagacagggt
30721   ttcgccaagt tggccaggct ggtctcgaac tctagacctc tggtgatcca cccgcctcag
30781   cctcccgaag tgctggatt acaggcttga gccaccacgc gcggctctgc ctgatagctg
30841   agagcataga actccaggtt tgagacctgg ctctgccaca tttctccctc tatgactgtg
30901   ggtgccccac tttgccttag ttttacctc tgtgaaatgg agcagatggc tggcacaggt
30961   agcaaaggag taaaagttat gtgggagggt ggtacctgag agagactcta gcttggtctt
31021   gccccacccc tggtgtaaac ataaagaagc ctccctggat ggctcaatct tctccaaaaa
31081   ggttagaggt gtaattccta gaggaggcga ccactagctg ggctttgaag gatgtgtagg
31141   agttcataag gacaggcatt ctgggcagga ggaacagcct gggcaaaagt tgggagcagg
31201   gagaaatctt gatggaggca ggaggaggag gaggtaggtt ggtgtaggcc aggYgcagtg
31261   gctcacacct gtaatcccag tgctttggga ggccaaagca agaggattgt ttgagcccag
31321   gagttcgaga ccagcctggg caacatagcg agaccctgtc tctaagaaaa aataaaaaaa
31381   ttagggtaca gtggcatatg cttgtattct caactactct ggaggctcaa gtgggaggat
31441   cacttgaacc caggaatttt tttgtttttg tttttgtttt tttgagatgg agtctcactc
31501   tgtggcccag gctggagtgc agtggtgcca tcttggctca ctgcagcctc ctccacctcc
31561   tgggttcaac cgattctgct gcctgagcct cccgagttgc tgggattaag gtgcccacca
31621   tcatgcccag ctaatttttt tgtatttta gtagagatag ggtttaccat gttagccagg
31681   ctggtcttga acgcctgacc gcaagagatc ctcctgcctc agtttcccaa agtgctggga
31741   ttataggtgt gagccactga gcctggtcaa gcccaggaat ttgaggttac agtcagctat
31801   gattgcacca ctgcattcca gcccaggtga cagagagaga cactgcccct aaaaaaaaaa
31861   aaaaaattga ttgatgggag gaagggtgag gttggcagag ccttgaatgc caggtggagg
31921   agctgggact ttccttcttg gggtgatagg gagtcatgga gggtttStga gcaggccagg
31981   gattagatag ctgaaggctg gatttactgg aagccaatga gcagttggct atggtccttg
32041   tccacgcggc ccatgttgtg ggcagtgacc gtattcaaga agggaaggac agacaagtat
32101   ttgaatactt cagtgaccag gatttggtaa aggactgcag gtcagggtca agaagaggtg
32161   agcaggac agacttcctc cccgctgcac caggcagctg agctgggttt cctctagggg
32221   ctgaggtttg agggtacctc aagttctgca agagtctata ggaggtggta agagagaaga
32281   gctggaggtc agagtttct tgactatata tatatatatt ttttgtttt tgttttaac
32341   agcttaacag ctttctgttt tattttgaa gacagggtct cagggtctca ctttgtcacc
32401   caggctggag tgcagtggta caatcgtagc tgactgcagc ctcaaactcc caggctcaag
32461   aaatcctcct cccaccctta gcctcctgag tagcagggac tacaggtgtg agccagcagg
32521   aagcccagct ggttttttt ttttctttgg tgtttttgt ttgtttgttt gagaccggag
32581   tttcgctctt attgcccagg ctgaagtgca atggcaggat cttagctcac cacaacctcc
32641   gaccccagg atcaagctat tctcttgcct cagccacctg agtagctggg attacaggca
32701   tgcgacacca cacaaggcta attttgtatt tttagtaaag acagggtttc tccatgttgg
32761   tcaggctggt ctcgaactcc caacctcaga tgatccacct gcctcggcct cccaaagtgc
32821   tgagattaca ggcatgagcc accgtgcccg gccttttttt tttttttttt tttttgaga
32881   cagagtctca ctctgtcgcc caggcaggag tgcagtggtK cgatctgggc tcactgcaag
32941   ctccgcctcc cgggttcact ccatcctcct gccttagcct cctgagtagc tgggactaca
33001   ggcgcccacc accacgcccg gctaattttt tgtattttta gtagagacgg ggtttcaccg
33061   tgttagccag gatggtcttg atctcctgac ctcgtgatcc gcccgccttg gcctcccaaa
33121   gtgctgggat tacaggcgtg agccaccatg tctggcctgg ccaggctggt cttgaactcc
33181   tgacttccgg tgatccatct gttctggcct cccaaagtgc tgggattaca ggcataagcc
33241   accacgccat gccgaagccc agcttgtttt taatttttt tttttttttt ggagaaatga
33301   ggtcttgcaa tgttgcccaa gctagccttg aactcctggc ctcaaatgac cccgccttgg
33361   catcccaaag tactgggatt acagatgtga gccaccatgc ccagcccttg ctttcttgag
33421   atacgattta gaataccata agattcatcc cttttaagca cataattcaa tgacttctgt
33481   acaaacaacc atgactacaa tctaatttta aaatatttca atcactctaa aaaagaaacc
33541   tcctgcttat gtacagcgac tctgtctacc tcttaagtga attctcctac ctttaatagc
33601   cctattttac agttcaggaa actgaggttc agagagacaa agtcacttac ccacagcaaa
33661   gaagcaaggc tgggtatcaa atgcaggacc ccccggtcc tgatgctttt ttttttttt
```

FIGURE 1-J

```
33721   ttttttcct  ctgagagaga  ctctcactct  gtcactcagt  ctagagtaca  gtggcgcgat
33781   ctcagttcac  tgcaatctct  gcctcctggg  ctgaagtaat  cctttcctca  caagtaaacc
33841   tcagcctctc  aagtagctgg  gactacaggc  acacaacacc  acgcctggct  aattttgta
33901   ttttaggta   gagacggggt  ttcactatRt  tggccaggct  ggtcttgaac  tcctgacctc
33961   aggtgatccg  cctgcctcgg  cccccaaag   tgttgggatt  acaggcgtga  gccaccacac
34021   gcagcctttt  tgttattaga  ctctgtcatt  actgactttt  tttttttttt aatagaaaca
34081   gggtctttct  ttcccaggct  aaagtacagt  ggcatgatca  cagttcacta  tagccttaaa
34141   ctcctgggct  caagtgatcc  tcctgcctca  gcctcccaag  tagcagggac  tacaggtgtg
34201   caccaccaca  cccagttaac  cattcattca  ttcattcatt  catttatttt  gagatggagt
34261   ctcgctctgt  cacctaggct  ggagtgcagt  ggcacgatct  cagctcactg  caacctccac
34321   ctcccaggtt  caagagattc  tcctgcctca  gcctcccgag  tagctgagac  tacaggcgtg
34381   caccaccatg  ccagactaat  ttttgtattt  taatagaga   cggggtttca  ctctgttggt
34441   caggcttatc  tcgaactcct  gacttcgtgg  atccaccctc  cttggcctcc  caaagtgctg
34501   ggattaaagg  cgtgagccac  cgcgccctgc  caaccttttt  ttaattttc   ttagagatgg
34561   gggtctccct  atgttgccca  ggcttgtctt  gaactcctgg  cctcaagtga  ccctcttgcc
34621   ttggcctcac  aaagtgctag  gattacagcc  tgagccatca  cacctggcca  acaggttttt
34681   ttttttgttt  tgttttgttt  tttaaagaat  gtctaggcca  ggctcattta  ctttcacctg
34741   taatcccagc  actttgggag  gccggggtgg  gcagatcact  tgaggtcagg  aattcgagac
34801   cagcctgggc  aacatgctga  aaccccgttt  ctactaaaaa  tacaaaaatt  agctgggtgt
34861   ggtgacacgt  gcctgtaatc  ccagctactc  aggaggttga  ggcaggagaa  ttgcttgaac
34921   ccaggaggca  gaggttgcag  tgagccaaga  tcatgccatc  accctccagc  ctgggcgaca
34981   gaaggagact  cagtctaaaa  acttaattaa  ttaattaatt  aaaaataaaa  atacaaaaat
35041   taacctggtg  tggtggtgtg  tgcctgtaat  ctaagctact  caggaggctg  aggcaggaga
35101   atcccctgaa  tcccagaggc  agaggttgca  gtgagccaag  atcgagccac  tgtttgccca
35161   gtctagtgca  ctgggctgct  gaatttattt  gaccagacac  ctagcaatag  actttgaagt
35221   tcttttccac  ttttcactct  aagatgctgc  tgtcatgaat  aaggaatatt  ttgatcccct
35281   tcacaaacac  tcggggcct   cttaccagtt  ttcactgaag  atcttgacat  tcctatctgc
35341   ttaggtgtct  gggcgtgttt  gggggagata  ctgaagaggt  agggctccca  ggcaggtgca
35401   gttcgtctgt  taggcaggca  gcaaggtcca  cttcaccaga  cacccccacc  tctgtttcc
35461   tgcagggact  ccagaacggg  tggaactggc  acccctcccc  tcttggcagc  cagtgggcaa
35521   gaaccttacc  ctacgctgcc  aggtggaggg  tggggccacc  cgggccaacc  tcaccgtagt
35581   gctgctccgt  ggggagaaSg  agctgaaacg  ggagccagct  gtgggggagc  ccgctgaggt
35641   cacgaccacg  gtgctggtga  ggagagatca  ccatggagcc  aatttctcgt  gccgcactga
35701   actggacctg  cggcccaag   ggctggagct  gtttgagaac  acctcggccc  cctaccagct
35761   ccagaccttt  ggtgaggatt  gaagaagcca  gcagggagaa  ggtgggggtg  gggtatcctg
35821   caatgcggtg  cctgtggcca  caggatcttt  tgagatgggt  gtggccccgg  ctaaggggtg
35881   catgtgttct  aggcgtatgt  gacctaggct  gctgagtggc  cctggaagag  gatctcgcag
35941   gagggggaat  gaaatgcccc  agagaagggc  ttcgggacgt  ccatccctgt  ctgctcacac
36001   ctttcttctc  tccctagtcc  tgccagcgac  tcccccacaa  cttgtcagcc  cccgggtcct
36061   agaggtggac  acgcagggga  ccgtggtctg  ttccctggac  Rggctgttcc  cagtctcgga
36121   ggcccaggtc  cacctggcac  tgggggacca  gaggttgaac  cccacagtca  cctatggcaa
36181   cgactccttc  tcggccaagg  cctcagtcag  tgtgaccgca  gaggacgagg  gcacccagcg
36241   gctgacgtgt  gcagtaatac  tggggaacca  gagccaggag  acactgcaga  cagtgaccat
36301   ctacagtaag  aagggggcagg  ggcggagtgg  ggcttcttgR  gggtgtgacc  tgaaccgggg
36361   gcggggctca  ctgtgtgcct  attccaggct  ttccggcgcc  caacRtgatt  ctgacgaagc
36421   cagaggtctc  agaagggacc  gaggtgacag  tgaagtgtga  ggcccaccct  agagccaagg
36481   tgacgctgaa  tggggttcca  gcccagccac  tgggccYgag  ggcccagctc  ctgctgaagg
36541   ccacccccaga ggacaacggg  cgcagcttct  cctgctctgc  aaccctggag  gtggccggcc
36601   agcttataca  caagaaccag  acccgggagc  ttcgtgtcct  gtgtgagtgg  ggctgctggt
36661   caatgcccc   tatcccccaa  ggcccaatct  ccctgaaggt  cccataaggt  cttgcctcca
36721   agtcctgccc  ccacccacct  ccatgtcatc  tcatcgtgtt  tttccagatg  gccccRact
36781   ggacgagagg  gattgtccgg  gaaactggac  gtggccagaa  aattcccagc  agactccaat
36841   gtgccaggct  tgggggaacc  cattgcccga  gctcaagtgt  ctaaaggatg  gcactttccc
36901   actgcccatc  ggggaatcag  tgactgtcac  tcgagatctt  gagggcacct  acctctgtcg
36961   ggccaggagc  actcaagggg  aggtcacccg  cRaggtgacc  gtgaatgtgc  tctgtgagtg
37021   agccggcggg  cagagctggg  tgggggcagg  ggccatggac  ctaatgcaat  cctcaccgcc
37081   tgttgtatcc  tcccacagc   cccccggtat  gagattgtca  tcatcactgt  ggtagcagcc
37141   gcagtcataa  tgggcactgc  aggcctcagc  acgtacctct  ataaccgcca  gcggaagatc
37201   aagaaataca  gactacaaca  ggcccaaaaa  gggaccccca  tgaaaccgaa  cacacaagcc
37261   acgcctccct  gaacctatcc  cgggacaggg  cctcttcctc  ggccttccca  tattggtggc
37321   agtggtgcca  cactgaacag  agtggaagac  atatgccatg  cagctacacc  taccggccct
37381   gggacgccgg  aggacagggc  attgtcctca  gtcagataca  acagcatttg  ggccatggt
37441   acctgcacac  ctaaaacact  aggccacgca  tctgatctgt  agtcacatga  ctaagccaag
```

FIGURE 1-K

```
37501   aggaaggagc aagactcaag acatgattga tggatgttaa agtctagcct gatgagaggg
37561   gaagtggtgg gggagacata gccccaccat gaggacatac aactgggaaa tactgaaact
37621   tgctgcctat tgggtatgct gaggYcccac agacttacag aagaagtggc cctccataga
37681   catgtgtagc atcaaaacac aaaggcccac acttcctgac ggatgccagc ttgggcactg
37741   ctgtctactg acgccaaccc ttgatgtatat gtatttattc atttgttatt ttaccagcta
37801   tttattgagt gtcttttatg taggctaaat gaacataggt ctctggcctc acggagctcc
37861   cagtcctRat cacattcaag gtcaccaggt acagttgtac aggttgtaca ctgcaggaga
37921   gtgcctggca aaaagatcaa atggggctgg gacttctcat tggccaacct gcctttcccc
37981   agaaggagtg attttctat cggcacaaaa gcactatatg gactggtaat ggttacaggt
38041   tcagagatta cccagtgagg cctattcct cccttccccc caaaactgac acctttgtta
38101   gccacctccc cacccacata catttctgcc agtgttcaca atgacactca gcggtcatgt
38161   ctggacatga gtgcccaggg aatatgccca agctatgcct tgtcctcttg tcctgtttgc
38221   atttcactgg gagcttgcac tatgcagctc cagtttcctg cagtgatcag ggtcctgcaa
38281   gcagtgggga aggggccaa ggtattggag gactccctcc cagcttttgga agcctcatcc
38341   gcgtgtgtgt gtgtgtgtat gtgtagacaa gctctcgctc tgtcacccag gctggagtgc
38401   agtggtgcaa tcatggttca ctgcagtctt gacctttgR gctcaagtga tcctcccacc
38461   tcagcctcct gagtagctgg gaccataggc tcacaacacc acacctggca aatttgattt
38521   ttttttttt tYcagagacg gggtctYgca acattgccca gacttccttt gtgttagtta
38581   ataaagcttt ctcaactgcc tcagccttgt gtgagttgag gggaggtgtc acatccagct
38641   ggagtccttt ctaagcagcc acagcctgat cctcccactt cctcccccaa gaaaacattg
38701   tgggttgatg gYcatacct gaggttctgg tccaaatcgg actttctatg accttctggg
38761   tctctagtga aaactaaaga ctcctctcca gaaaaaaca tttggtttct aatgaggcct
38821   ggaatcttat tcttgacctg gggagcggaa tcccttttg cagtactccc gggccctctg
38881   ttggggcctc ccttcctct ccagggtgga gtcgaggagg cggggctgcg ggcctcctta
38941   tctctagagc cggccctggc tctctggcgc ggggcccctt agtccgggct ttttgccatg
39001   gggtctctgt tccctctgtc gctgctgttt tttttggcgg ccgcctaccc gggagttggg
39061   agcgcgctgg gacgccggac taaggggcg caaagcctcc agggtagccc tctcgcgccc
39121   tccgggacct cagtgcccct ctgggtgcgc atgagcccgg agttcgtggc tgtgcagccg
39181   gggaagtcag tgcagctcaa ttgcagcaac agctgtcccc agccgcagaa ttccagcctc
39241   cgcacccccgc tgcggcaagg caagacgctc agagggccgg gttgggtgtc ttaccagctg
39301   ctcgacgtga gggcctggag ctccctcgcg cactgcctcg tgacctgcgc aggaaaaaca
39361   cgctgggcca cctccaggat caccgcctac agtgagggac aggggctcgg tcccggctgg
39421   ggtgagggga ggggctgga agaggtgggg gaagggtagt tgacagtcgc tctataggga
39481   gcgcccgcgg acctcactca gaggctccc cttgccttag aaccgcccca cagcgtgatt
39541   ttggagcctc cggtcttaaa gggcaggaaa tacactttgc gctgccacgt gacgcaggtg
39601   ttcccggtgg gctacttggt ggtgaccctg aggcatggaa gccgggtcat ctattccgaa
39661   agcctggagc gcttcaccgg cctggatctg gccaacgtga ccttgaccta cgagtttgct
39721   gctggacccc gcgacttctg gcagcccgtg atctgccacg cgcgcctcaa tctcgacggc
39781   ctggtggtcc gcaacagctc ggcacccatt acactgatgc tcggtgaggc accccctgtaa
39841   ccctcgggac taggaggaag ggggcaggga gagttatgac cccgagaggg cgcacagacc
39901   aagcgtgagc tccacgcggg tcgacagacc tccctgtgtt ccgttcctaa ttctcgcctt
39961   ctgctcccag cttggagccc cgcgcccaca gctttggcct ccggttccat cgctgccctt
40021   gtagggatcc tcctcactgt gggcgctgcg tacctatgca agtgcctagc tatgaagtcc
40081   caggcgtaaa gggggatgtt ctatgccggc tgagcgagaa aagaggaat atgaaacaat
40141   ctggggaaat ggccatacat ggtggctgac gcctgtaatc ccagcacttt ggggaggccga
40201   ggcaggagaa tcgcttgagc ccaggagttc gagaccagcc tggacaacat agtgagaccc
40261   cgtctatgca aaaatacac aaattagcct ggtgtggtgg cccgcacctg tggtcccagc
40321   tacccgggag gctgagttgg gaggatcctt tgacccctga agtcgaggt tgcagtgagc
40381   cttgatcgtg ccactgcact ccagcctggg ggacagagca cgaccctgtc tccaaaaata
40441   aaataaaaat aaaaataaat attggcgggg gaaccctctg gaatcaataa aggcttcctt
40501   aaccagcctc tgtcctgtga cctaagggtc cgcattactg cccttcttcg gaggaactgg
40561   tttgtttttg ttgttgttgt tgttttgcg atcactttct ccaagttcct tgtctccctg
40621   agggcacctg aggtttcctc actcagggcc cacctggggt cccgaagccc cagactctgt
40681   gtaKccccag cgggtgtcac agaaacctct ccttctgctg gccttatcga gtgggatcag
40741   cgcggggccgg ggagagccac gggcaggggc ggggtggggt tcatggtatg gctttcctga
40801   ttggcgccgc cgccaccacg cggcagctct gattggatgt taagtttcct atcccagccS
40861   caccttcaga ccctgtgctt tcctggaggc caaacaactg tggagcgaga actcatctcc
40921   aaaataactt accacgctgg agtgagacca cgaatggtgg gaaggggagg gtcccacgga
40981   catattgagg gacgtggata cgcagaagag gtatccatgt ggtggcagcc gggaagggt
41041   gatcagatgg tccacaggga atatcacaaa ctcgaattct gacgatgttc tggtagtcac
41101   ccagccagat gagcgcatgg agttggggt ggggtgtc aaagcttggg gcccggaagc
41161   ggagtcaaaa gcatcaccct cggtcccttg ttctcgcgtg gatgtcaggg ccYccaccca
41221   ccgagcagaa ggcggactca ggggcgctcc agggtggctc gagctcacac acgctgagta
```

FIGURE 1-L

```
41281    gacacgtgcc cgctgcaccc tgggtaaata cagacccgga gccgagcgga ttctaattta
41341    gacgcccgcg aacgctgcgc gcacgcacac gtgtcctcgg ctcgctggca ctttcgtccc
41401    gccccctccg tcgcgtgcSg gagctgaccc ggaggggtgc ttagaggtat ggctccgcgg
41461    ggtcaaaagg agaaggatca gtgagagagg catcccccaca ccctccccta gaactgtcct
41521    ttccccatcc agtgcctccc aaatctctct tagtccccaa atgtatcccc gccctaaggg
41581    gcgctggtgg gaggagctaa atgtggggggc ggRgctcgga gtccagctta ttatcatggc
41641    atctcagcca gggctgggt aggggtttgg gaagggcaac ccagcatccc ccgatcccag
41701    agtcgcggcc ggggatgacg cgagagagcg tggtcgcccc cagaaggccc tgggccatca
41761    tgccggcctc cacgtagacc ccaggggtcg ctcactcctg ccagctcgcc ttcaccaagg
41821    ccaggagctt agcgcacgct cgcctcccgc cccccgccg cctctgccgc cgcccctcc
41881    ttggaaacca agttaccaac gttaaaccaa tccccaagcg caactctgcc tccccacac
41941    cccacccgcc gcgccgcgcg gagccgtcct ctagcccagc tcctcggctc gcgctctcct
42001    cgcctcctgt gctttccccg ccgcggcgat gccagggcct tcgccagggc tgcgccgggc
42061    gctactcggc ctctgggctg ctctgggcct ggggctcttc ggcctctcag gtaagagccc
42121    cgctctggtt cggggtggac agggcggggg cggagtccct ggacctgaga aacgcctcc
42181    tgtccctccc agctctgccc tcgcctcgct cccacgcctc tgcccccacc tcgagcctga
42241    gtcttctccc cttccccctc ctccccaaca cacacccgag ccccagcttc ctgactcctc
42301    gatagcccct acccgcttcg agatcctagg tgttcttccg cacccaaccc ttcgccctgg
42361    agacccagtg tctctcctgt ccgctcccg ggtacctcct tacgctStgc tgtgcaccat
42421    ggtccacgga ctggcatctt ccccactcgc ggtccgcgaa gactccatct ctccaactac
42481    cctgactcag aggcgctgtt cccgctccac ccagagccct ggcaaccggg tccctcagct
42541    gttcccgcgg ttccttccat gagcccagcc ttgcgtcccg gctccgtgtt cttcaccggg
42601    tgtagggtcc ttcctgatcc ttgacccagc ctcgtctctc ctttgccctt gccgcaaacg
42661    cactcctc gtatcccggc attctgccag gaccctgaga actggttcat ccccatccc
42721    ccatcccggg tccccttctc tcagccttgc tgtgttcatc caagaaccca cctttcctct
42781    cctctacgcc ctccccccat gctttcccgc cgctccatcg gcgctttgga gaccatggct
42841    ctctgctacc acgtccagga gacaccctcg aggtttagac tctgggagtg cgcctttaaa
42901    ccggaggcct gggcaggacg cgggacgcct gggttctttc cctggctgca gcctctcctc
42961    ctcctccccg ccctctgaga acccttgact cgacataggg gcgctaagat gtcagggagt
43021    tggctcccca ggctcagccc gcgtttccct gggcagcggt ctcgcaggag cccttctggg
43081    cggacctgca gcctcgcgtg gcgttcgtgg agcgcggggg ctcgctgtgg ctgaattgca
43141    gcaccaactg ccctcggccg gagcgcggtg gcctggagac ctcgctgcgc cgaaacggga
43201    cccagagggg tttgcgttgg ttggcgcggc agctggtgga cattcgcgag ccggagactc
43261    agcccgtctg cttcttccgc tgcgcgcggc gcacactaca ggcgcgtggg ctcattcgca
43321    cttccgtga gttctgggtg gccacgcgcg tactccacta ctctccctcc ctcccaggcc
43381    ccgcccctg ggtcccaggg tcctcccctt caggccccac ctttctgttcc aagtcccggY
43441    gttcaaagag ctgcggactc ttcccccttg cagagcgacc agatcgcgta gagctgatgc
43501    cgctgcctcc ctggcagccg gtgggcgaga acttcaccct gagctgtagg gtccccggcg
43561    ccgggccccg tgcgagcctc acgctgaccc tgctgcgggg cgcccaggag ctgatccgcc
43621    gcagcttcgc cggtgaacca ccccgagcgc ggggcgcggt gctcacagcc acggtactgg
43681    ctcggaggga ggaccatgga gccaatttct cgtgtcgcgc cgagctggac ctgcggccgc
43741    acggactggg actgtttgaa aacagctcgg cccccagaga gctccgaacc ttctgtgagt
43801    gggtgtgggg aggagatggg gacccagtgg ggtcggtcgg tgtttaggag gtttagaggt
43861    agatacatct gaatgctgac cccgacttca accctcgccg gctgagctgt ttcccccctcc
43921    gtgccttgag gatgataata cgataagata gtgcatgtca agtgcttagg acatattgag
43981    cgctcggagt tagttcaaac ttggttcttc gaccctagc cctgtctccg gatgccccgc
44041    gcctcgctgc tccccggctc ttggaagttg gctcggaaag gcccgtgagc tgcactctgg
44101    acggactgtt tccagcctca gaggccaggg tctacctcgc actgggggac cagaatctga
44161    gtcctgatgt caccctcgaa ggggacgcat tcgtggccac tgccacagcc acagctagcg
44221    cagagcagga gggtgccagg cagctgRtct gcaacgtcac cctgggggc gaaaaccggg
44281    agacccggga gaacgtgacc atctacagta aggaaggagg cggggtctcc gcggctccga
44341    ggtgggacca gaggaatgcg aaggcggggc gaagagtggg cgggacctca gtaccggaac
44401    aggcgtggcc cgaggggcgg ggcaggtggg ggcggagacg taatcgctgg ggaggaggag
44461    cctgtacagc ctgagaggcg gggcgccgta ccctagttcg ttctcagcac cccgaggatt
44521    cgggcagata aggggcgggc cttgaccgga gggagggta tggtcagtat actacgacca
44581    aatgctccgc ccccaggctt ccggcacca ctcctgaccc tgagcgaacc cagcgtctcc
44641    gagggcaga tggtgacagt aacctgcgca gctgggRccc aagctctggt cacactggag
44701    ggagttccag ccgcggtccc gggcagccc gccagcttc agctaaatgc caccgagaac
44761    gacgacagac gcagcttctt ctgcgacgcc accctcgatg tggacgggga gaccctgatc
44821    aagaacagga gcgcagagct tcgtgtccta tgtgagttgg tgataacccc tcgcccccca
44881    ccttctggtg acttccaagg acccgcctgc tccctcaccg tgtcgtggag gcggagccat
44941    ttcttacgtc taagcctctg taaccccacg ccctgcccgc agacgctccc cggctagacg
45001    attcggactg ccccaggagt tggacgtggc ccgagggccc agagcagacg ctgcgctgcg
```

FIGURE 1-M

```
45061    aggcccgcgg gaacccagaa ccctcagtgc actgtgcgcg ctccgacggc ggggccgtgc
45121    tggctctggg cctgctgggt ccagtcactc gggcgctctc aggcacttac cgctgcaagg
45181    cggccaatga tcaaggcgag gcggtcaagg acgtaacgct aacggtggag tgtgagtggg
45241    ggtgcgcagg gtgcaYttct atctggttca aggtctggag ggtggccagc ctccagggaa
45301    gagtaggagt agggtatgag gtgtcccttt gggtgaggtt ttgggaaagg gaagaggctg
45361    gttagtgggg ttggagaaag atcttggagg atggaaggga ccgggtgggc gtgccctag
45421    cctagggcgt ggtatttggg cggagtcgtg gaaaggcggg cagtccagag tgtttaagtt
45481    tttagacgaa aaaggcgcca ctggtggctc aggaagctcc cagacagagt gcatgSctcg
45541    actagcgtga caccctccttg gatcggcgtc caagggttat gcagggacaa cacttcgtgg
45601    aagccttgcc gcgccaagga gggtctaggg acgtcagatt tgcccccaaa ccccaaagcc
45661    aacaatacac tccctcctcc agacgcacca gcgctggaca gcgtgggctg cccagaacgc
45721    attacttggc tggagggaac agaagcctcg ctgagctgtg tggcgcacgg ggtaccgccg
45781    cctgatgtga tctgcgtgcg ctctggagaa ctcggggccg tcatcgaggg gctgttgcgt
45841    gtggcccggg agcatgcggg cacttaccgc tgcgaagcca ccaaccctcg gggctctgcg
45901    gccaaaaatg tggccgtcac ggtggaatgt gagtaggggc accgcggagt taggcaggat
45961    ctgtgggaca accccggctg gacttcctgg cccccgtgtg agccctgca atcctgtttc
46021    ccagatggcc ccaggtttga ggagccgagc tgccccagca attggacatg ggtggaagga
46081    tctgggcgcc tgttttcctg tgaggtcgat gggaagccac agccaagcgt gaagtgcgtg
46141    ggctccgggg gcRccactga gggggtgctg ctgccgctgg caccccagag ccctagtccc
46201    agagctccca gaatccctag agtcctggca cccgtatct acgtctgcaa cgccaccaac
46261    cgccacggct ccgtggccaa aacagtcgtc gtgagcgcgg agtgtgagcg aggccaggc
46321    gggtagggag caggggtgcc ccacggtcca ggcactccct gacatccccc atggctgctt
46381    tgcagcgcca ccggagatgg atgaatctac ctgcccaagt caccagacgt ggctggaagg
46441    ggctgaggct tccgcgctgg cctgcgccgc ccggggtcgc ccttcccag gagtgcgctg
46501    ctctcggaa ggcatcccat ggcctgagca gcagcgcgtg tcccgagagg acgcgggcac
46561    ttaccactgt gtggccacca atgcgcatg cacggactcc cggaccgtca ctgtgggcgt
46621    ggaatgtgag tgggggcagc accggatgga gggacacgg tcctcggaag aatgactcgc
46681    agcggtggga gcattcaagg gcacctctcc caatcccatt ctcggggaca gggaattcca
46741    gcctaaacca gggggtaatg aaaattctag ccaggcgcag tggctcaggt ctgtaatccc
46801    aacactttgg aaggttgagg cggatgaatc acttgaggcc aggagttcga gaccagcccg
46861    gccaacatgc cgaaaacccg tctctacaaa aattagccgg tcgtggtggt gggcgcctgt
46921    ggtcccagct acttgggagg ctgaggcagg agaatcgctt gagcctggga ggcagaggtt
46981    gcagggagcc gagatcccgc cactgcactc cagcctgggc aacagagtga gactctttct
47041    tagaaaaaca gaaaaagaaa attatcggga ataggagcac ggccctcctc aaatcctgga
47101    ttagaacact gacctgggct tcacctcctt ccattcggtg aagaagggcg aggaattta
47161    gccgcaacag cagcctgatt gtcggggaag gaggctctga taggaggcag gatcctcttc
47221    tgcccatcag aggcgcggtg gtctcccatc gatcgttgtg ggccggagca gggcatttga
47281    tcagtggctg ggccggcgct aagccccact tcaccttctg tgcccttcag accggccagt
47341    ggtggccgaa cttgctgcct cgccccctgg aggcgtgcgc ccaggaggaa acttcacgtt
47401    gacctgccgc gcggaggcct ggcctccagc ccagatcagc tggcgcgcgc ccccgggggc
47461    cctcaacatc ggcctgtcga gcaacaacag cacactgagc gtgcaggcg ccatgggaag
47521    ccacggcggc gagtacgagt gcgcaSccac caacgcgcac gggcgccacg cgcggcgcat
47581    cacggtgcgc gtggccggta agtggcagct ggggagaggc ggggcgaggt atctgagagg
47641    gggcgtgacc tgggtcttgg ggcggccggc cccgcctgcc tccctctcgg tccggKaga
47701    ctagacggaa gtgggacaga gtagaagtca aaggtgcctt agcgggtggg gctgttgatc
47761    gcactttgag ggtggggaga tggagtggc aggggactg aattcaaggg gaggggaccct
47821    ccggggctgt cactgctgca ggaaaggact ttaaaacttg ggctggattc tgcgtggtgg
47881    aaacttgacc caattcacaa tccactgtgg ggaagattgg ggagggacca aagtcattgg
47941    atgWtggagg gagagagggg tcaagatcgc cttctctcac ttcctgaagc tcctggggct
48001    gggttctctc tggggtcggg ggaacctgac ctggtcctgc cggtcctcat tttttggggg
48061    atggggagag ttgacttgtc gccaggggc taagtgtggt cacgggttta tatcccatg
48121    ggctgaagtg cgatataaat cgggactcgg gtcgccctgg cactgggagt ggccttattg
48181    catgggttgt ctcccttctc ccaaggccag acagtgagct ccccgggca tgaggactga
48241    cttcgtgcct gtgggagtgc ggggggcggt gggagaagcc ccccggagct tggccaccct
48301    ccgcgaggt ctccaccccg caggtccgtg gctatgggtc gccgtgggcg gcgcggcggg
48361    gggcgcggcg ctgctggccg cgggggccgg cctggccttc tacgtgcagt ccaccgcctg
48421    caagaagggc gagtacaacg tgcaggaggc cgagagctca ggcgaggccg tgtgtctgaa
48481    cggagcgggc ggcggcgctg gcgggggcggc aggcgcggag ggcggacccS aggcggcggg
48541    gggcgcgggcc gagtcgccgg cgagggcga ggtcttcgcc atacagctga catcgcgtg
48601    agcccgctcc cctctcccg cgggcggggg dacgccccc agactcacac gggggcttat
48661    ttattgcttt atttatttac ttattcattt atttatgtat tcaactccaa gggcgtcacc
48721    cccattttct acccatcccc tcaataaagt ttttataaag gaactccctg tctccgcttc
48781    tgtttctgca aggtggaaca agcccagggt tccagtcgtg acctcccgag ttattcattc
```

FIGURE 1-N

```
48841  aaaaagcgat ttttgagagg gcctggggtg gtggcttagg cctgtaatcc caggacttgt
48901  gggaggccca ggtgggagga tcccttgcac ccaagagttt cagaccagcc tgggcaacat
48961  agggagaccc tacaaaaaat attttttcaaa aattagccaa ggccggtcgc ggtggctcat
49021  gcgtgtaatc ccaggacttt ggaaggccga ggcggccaga tcacgaggtc gaggtcatga
49081  gatcgagacc atcctggcca atatggtgaa accctgtctc tactaaaaat acaaaaatta
49141  gctgggcatg gtggtgcgcg cctgtagtcc cagctattcg ggaggctgag gcaggagaat
49201  cgctttaacc ccggaggcag aggttgcagt gagccgagat cgtgccactg aactccagcc
49261  tggcgacaga gcgagattcc gtcttaaaaa aaaaaccagg cgtggtggct cacgcctgta
49321  atcccagcac tttgggaggc cgaggcgggc ggatcacgag gtcggagat cgagaccatc
49381  ctcgctaaca cggtgaaacc ccgtctctac taaaaataca aaaaaaaaa aaaaaaaaa
49441  attagccgag cgtggtggcg gcgcctgta gtcccagcta ctcaggaggc tgaggcagga
49501  gaatggcatg aacccgggga gcagagcttg cagtgagccg agatcgcgcc actgcactcc
49561  accctggcag acagcaagac tccgtctcaa aaaaaaaaa aaaaattagc cagggccgag
49621  cacagtactc tcgcttgaat cccagaactt gggaaacta aggcgggggg ggggggtcac
49681  ttgaggtcag gagttcgaga ccacccctggc caacgtggtg aaacaccttc tctaccaaaa
49741  atacaaaaaa attaaggccg ggtgaagtgg ctcacgtctg taatcccagc actttgcgag
49801  gctgaggcgg gcggatcatg gggttagag atcaagactg tcctggctaa catggtgaaa
49861  ccccgtcact actaaaaaca caaaaattag ccgggcgtgg tggcacatgc ctgtagtccc
49921  agctactcaa gaggctgagg caggagaatc gctttaaccc cggaggcaga ggttgcagtg
49981  agccaagatc gcaccactgc actccagcct gggcaataga gcgagactct gtctcaaaaa
50041  aaaaccaaaa acaaaaacaa aaaatacaa aaatttagct gggctgtagt ggcacacgcc
50101  ctgtaatccc agctactcgt gaggctgagg caggagaatt gctagaaccc gggaggtaga
50161  gatcttgcca ttgcactcca gcctgggcaa cagaactaga ctctgtctca aaaaaaaaa
50221  aaaaaaaaaa aaagtgtttt tgaggggggc tgggcatggt ggctcaagcc tgtaatccca
50281  ggacttttgg gaggcccagg tgggaggatc ccttgtgccc acgagtttca gaccagcctg
50341  ggcaacatag cgagaccccta caaaaaaaca tgtttcaaaa aaaattttt tttttttgaga
50401  tggagtctcg ctctgtcgcc caggctggac agcagtggca ctatctctgc tcactgcaag
50461  ctccgtctcc cgggttcatg ccattctcct gcctcagcct cccaagtagc tgggattaca
50521  ggcgcctgcc accacaccca gctaattttt ttttgtattt ttagtagaga tgggatttca
50581  ccgtgttcgc caggatggtc tctattcctg acctcgagat ccacccgcct cagcctccca
50641  aagtgctggg attacaggcg tgagccaccg cgcccggcct caaaaaaaa atttttttt
50701  tgagatggag tcttgctctg tcacccaggc tggagtgctg tggtgtgatc ttggctcact
50761  gcaacctctg cctcctgggt tcaagcaatt cccctgcctt ggcttcccaa atagctggga
50821  ctataggcat gcaccaccac acccagctaa ttttttgtatt tttagtagag acagggtttc
50881  accatgttgg ccaggctggt ctcgaactcc tgacctaagg tgatccacct gcctcggtct
50941  cccaaagtgc tgggattaca gctgtaagcc accatgcctg gtgtattttt caaaaattag
51001  ccagacatgg tggtgcatgc ctgtagtccc agctacttgg gaggctgagg caggaggatc
51061  ctttgagcct aggaggtcaa agccacttcc agctatgata tYgtcattgt gctccagccc
51121  agtgacaga accagaccct gtctctaaaa acaaacaacg aaaaaatcca aaaacttttt
51181  ttgaacacct actatgcatc aggcacaatc taagctgtct ttttctttt cttttttttt
51241  tttttttgag acggagtctc tctgtcgccc aggctggagt gcagtggtgt aatctcagct
51301  cactgcaagc tctgcctccc acgttcaagc gattttcctg cctcagcctc ctgagtagct
51361  gggattacag gcgcgcgcca ccactacgcc cggctaattt ttgtattttt agtagagaca
51421  gggtttcacc atgttggtca ggctagtctg gaactactga cctcgtgatt cacctgcctc
51481  ggtctcccaa cgtgctggaa ttacaagcct gagccactgt gcctggcccg gctggctgtc
51541  ttttctcagt gtgacctaga gctcgtcctc tctcagtgcc tgttttctgc tctcttcaca
51601  cccttgggca gggtgggggg cctcactcct tcctcctact tatctcttcc acccagcact
51661  gccctctgat ccgggtcact cttggaggtg ggggctaggt gcttccccca ggcctggtta
51721  ccggcagagc tgaggccgcc ttgccagggt gggtggaggc cctctccgtt gtgcccctgc
51781  cctgagactt cggtgagacc ttcctgggca ggcactggct gatgctatgg gtgtcagccc
51841  ttagcatgtc ctccctgtta aaggggcac ccctgccccg ccctcaatgc ctcctttgtc
51901  ctgtgtccac ccacagtgct tcagtttacc ccacccctgc ctttccactc agcccatcat
51961  gattcagaac agacacacac agggtatccg ctgcaacccc cactacacgg caccttcccc
52021  cctcatcccc aacagcataa ggcacagcag ctgggcctcc tccccacagc ctcctcctct
52081  gcccctcctc cctcaaaagc aggaacacgg agccctagag aaggaagcca gtcccatgca
52141  aacatgtaat gagcaaagat gagacgggga aatggcacaa gagggcaggc cagtgctcgg
52201  tgctggagcc aggggccagg tataacaccc aaaaaggcac cagccaggtg cagtccctgc
52261  cactaacagc acctcacctt ttctgcctgt gccctcccta cttaatgatc tctctccgct
52321  cctactgacc tcaaggtctc tttcagagcc ttcagatgag atatttattt tagtaggttg
52381  gtgcaaaagt aattgctgtt tttgccattg aaagtaatgg caggcagggc atggtggctc
52441  acgcctgtaa tcccagcact tgggaggccc gaggtgggca gatcacgagg tcaggagttc
52501  aagaccagcc tggctaacat ggtgaaaccc tgtctctact aacaatacaa aaaaattag
52561  ccggacatgg tggcacaccc ctgtagtctc agctacttgg gaggctgagg caggagaact
```

FIGURE 1-O

```
52621   gcttgaaccc tgaagcggag gctgcagtga gctgaaatca cgccactgca ctccagcctg
52681   ggccacagag tgagactgtc tcagaggaaa aaaaaaaaaa aaaagtaatg gcaaaaactg
52741   caattacttt ttcttttttct ttctgttttt tttttgttt gtttgtttgt ttgtttgttt
52801   gtttgagacg gagtctcact gtgtggccca ggctggagtg cagtggcgca atcttggctt
52861   actgcagcct ccgcctccca ggttcaagtg attctctcct gcctcagcct cccaatagga
52921   ttacaggcac ccaccactat gcctggctaa ttttttgtatc tttagcagag atggggtttc
52981   accatgtttg ccaggctggt ctcgaactcc tgatccaccc acctcagctt cccaaagtgc
53041   tgggattaca ggcaggcatg agccatggtg cccgacattt ttttttttttt ttcttttttt
53101   ttttgagaca gagtctcact tgtcaccca ggctggagtg caaaggcaag atctcactgc
53161   agcctctgcc tcctgggtta aagcgattct cccaccttag cccctgagt aggtgagatt
53221   acaggcacat gccaccacac ctgcctaatt tttgtatttt taatagagag ggggtttcac
53281   cattttgtcc acgctggtct cgaactcctg acctcaaggg attcgcccac ctcagcctcc
53341   caaagtgctg ggattacagg catgagccac cacgcccgac ctccttaact cttttatttc
53401   cttgcacact ttttctctgt agcccagctc acaacttaac atcctcttag acatacacct
53461   gaggttttttt ttttttttttt ttttgagagg gagtctctct ctgtcaccca ggatggaatg
53521   cagtggtgtg ctctcagctc actgcaacct tgcaaccact gcctcccagg ttcaagcaat
53581   tctcctgcct cagcctcccg agtagctggg actacagaca catgccgcca cacctggctg
53641   atttttttgtt ttttagtaga cacagggttt caccgtgttg cccaggctgg tctcaaactc
53701   ctgagttcag gcagtccgcc tgccttagcc ttccaaaatg ctgggattac aggcatgagg
53761   caccgcgtcc tgcctctgag tttttttttt tttttttttt ttactgtctc ctagaacatc
53821   agcccagta gagcagggat ctttgttctg ttcaccactg agggtcctca ttgggtccta
53881   gcacacacag ttgctcaata aatgttgaat aagtgggtaa agacagccac gagcttgcag
53941   atatgtgttc aaggtgtgtc cttgcagaga gcttctctat acttggcact ggagaggcct
54001   gtcgtgggca aggacataga tgtggcgacc tcagacttga gaactcctgg ggcagtaggg
54061   gagatggatg tggataatgt aaccataagc cttcctttct attttagact gagtggtcaa
54121   ggaaggcttc cagacaatgg aaattctgat aggttctaag agggagacca gcaaggagct
54181   gaaccggagg ctgacacagg gtgagagtgg gaatgtctat tttattttt ttttggagac
54241   agggtctcac tctgttgctc aggcagcagt gcagtggcac gatcgtggct cactgcagct
54301   tcaacttccc agactcaagt gatcctccca cctcagcctc ccaagcagct gggaatatag
54361   gtgcatgcca ccacatccgg ctaattttttg tatttttggt agaaacgggg tttcaccatg
54421   ttgcccaggc tggtcttgaa ctcctgggtt caagtgatct tgctgccttg ggctcccaaa
54481   gtgcttggat tacaggtgtg agcctgctag ccacatctgg cctatttttat tttttaatta
54541   gttttttgtt tttgtttttg ttttgagatg gagtctctgt ctccaaggct ggagtgcagt
54601   ggcacgatct cggctcactg taacctccac ctcccaagta gctgggatta caggcacatg
54661   ccaccacgcc tggctaattt ttgtatcttt agtagagaca gggtttcccc atgttggcca
54721   ggctggtctc gaactcctga cctccggtga tccacctgcc tcagtttccc aaagtgctgg
54781   gattatagga atgagccact ctgcctggct gggcatgtgt cttgttttttt tcattctgta
54841   gataacaagc aattgtcctc cctcagcctc ccaagtagct ggtactacag gcgcctgcca
54901   ctacgcccgg ctattttttg tagttttagc agaggtgggg tttcaccatg ttaaccagtc
54961   tctaactcct gacctcaggt gatcctcctg ccttggcctc ccaaagtgct ggaattacag
55021   gtgtgagcca ccaagcccag cctcaaactc ctgagtttaa gtgatcctca cacctcagcc
55081   tccctgagtg ctgggattac aggtgtgagc caccacaccc ggcctgagtc ggggaggtg
55141   tctatttttag tctgagtggt caaggaaggc ttctctgaag agctgatgtt ggggccaggc
55201   ctcctcaagc gattagaagg tgtcagccat ggggagatgt ggagggaggg tgtttcaggc
55261   caaggaaggg taagatcaaa taattcaggg atctgagggc agaggaatct ggactccagt
55321   tctcccattc agggctgccc aggagagaca aagaggatct cataagggtg tgtggcttttg
55381   tggctcactc acgcccacag caaggaccat gcccaccctta cttttttttt tttcccccaag
55441   tctccctcta ttacccaggc tggagtacag tggtacgatc acggttcact gcagtcttga
55501   cctccagggc tcaagtgatc ctcccacctc agtgtcctga gtagctggca ctacaggcat
55561   gcaccaccac ccctggctca ttttttgatt ttttggtaga cacggggtct cactgtgtta
55621   cccaggctgg tctcaaactc ctgggctcaa gcgatcctcc cacctctgcc ttctgaagtg
55681   ttgggattac aggtgtgagc caccatgccc agcccgccac cagtcttgac tctccatcct
55741   ccctccctcc ctgtgagtgc tggtggcctg tgtgtcccgc ctgctgaaag atgcctctga
55801   cttggggctt tgacttcag gcccgggaga cacattttgg ctggattagg gagatcttaa
55861   aaggggtag gggacacagc aggggctaag gagagtgaca cactgcaggc aggggttggg
55921   tgacagatga aggatccact ggtatatgct gccagtgtgt gccatctact tgtgtgttttt
55981   acgtgtgtct ggtgcatgtg tcctgtgtgg gctgtatctg tgtgtgactc agctacgtgt
56041   cagcatatcc ctgtcgacgt gtgtctctgc tgatgtgtct gtcagcacgc acggctgtct
56101   tgcatgtgtc ttttttgaga tagagtctcg ctctgtcacc caggctggag tgcagtggca
56161   cgatcttggc tcattgcaac ctcaacctcc caggttcaag cgattctcct gcctgagcct
56221   cccaagtagc tcggattaca ggcacatgct accacgcctg gctaattttt gcatatttag
56281   tagagacggg gtttcatcat gttggccagg ctggtctcga tctcctgacc tcaggtgatc
56341   cacctgcatc agcctcccaa agtgctggga ttacagaaat gagccactgt gcctggctag
```

FIGURE 1-P

```
56401    acatgtgtct ttttttttcc cttctgtata taacagggtc tcactatgtt gcccaggctg
56461    gtctcaaact cgtggcctca agcaatcctc ctgcctcagc ctcccaaagt gttgggatta
56521    caggcgtgag ccactgcacc cggcttgtgt gtgtctttct gtatctgttg tgtgtgtctg
56581    tgggtagtgg ctgtttccct gcatgggaca ttgtggtaaa tgtggctaat tccctgtgtg
56641    ggggctgctg cctgtggata agactgtgtc tctgtgcatg cgcacgtgtg tgcacgcccc
56701    tcacaacccc aacgagaaaa cacctgtcca ccttcctggg ctggcacagg ggcacaggag
56761    gcgggatccc aaatcacagg cttttctct cggcatatct ctgtacttta ttgtccctgc
56821    tgtaacaatg ctcatccttc ctgagagcgt ctcctgaggg ggcctcggcc aaggctgact
56881    ggagaagggg ctggtgaccc ctagcaggct ctgccacctg aggcctgggt cttcccccgg
56941    gatccttgaa tctggagatg gcagagagga ggcaggccgg ctctttcccc aatcctccta
57001    ggagagctgc ttctgcccat tctcccactg gtgaaacgga ggcagaagca gcagctcagc
57061    agggtgaagc tgggtttaac cttcctgaaY ggggtccagg acactccac atctgccaca
57121    tagcctcttg ggctggacat ttttcctggg caccagccag cagctggagc agcgagtgcc
57181    gtatttcttg tacctagggt tggggacaa gaaactgcca tttaggatgc agtggggcc
57241    cggaaaccgc cacaaggaaa ccacttttcc caagaggtag gtgttttgct ttttgctttc
57301    cccacaggcc atcctggtta cacgtggact gatttgggga cccccgcccc aactccctcc
57361    tccattctaa ggacctgatc ccacaggcgt tgcagagagg gtccatct tcagcgtctc
57421    tccagagcgg ggtcctctgg gtccgacagg aagcacagcg ccggggctct gaagggtcag
57481    aggtcaaagg gcaggggtca gaggccaagc atgtgagctc gggatgcctg tgcggagtcg
57541    ggcattttgt gggggtctca gtaaaggccc cacctagctc tggatcagcc ctgggagttg
57601    ccagctctaa gccacagcaa agccaggaag ggagacagat ggcagcattc cgcagaggag
57661    gaagctgggg gtgggggtga ctcagcccaa gtggaggggg gtgctgcgac tcctccctga
57721    gggctctaaa tggggaagca agatggagaa gggggggggca gggagaaagg cagggaagac
57781    aggaaattgg ccccccaaaat atttatagct cttgggtttt caggactcac ccagggcctc
57841    gctgcctgct gagtgggcct cggtgcctcc tgggtgggct gcagggcccc caacagcatc
57901    tgcaggggat tcctgagaac ggctactgca gggcaggctg tggggcagac aaggtattag
57961    cactgggggg gatctgtagc ttgtccccaa cagccctccg aaatgaagat ttagtatcaa
58021    ggtatcagcc atccccgag gaggcaacta atatctgaat ggcctggctt tgcctctcat
58081    tagtaatatt attattatta ttattattat ttttgcagat ggagtctcgc tctgttgccc
58141    aggctggagt gtagtggtgt catctcagct cactacaacc tccacctccc gggttcaagc
58201    aattcttgag cctcagcctc ccaagcagct gggactacag gcgcgcgaca ccacgcccag
58261    ctaattttg tatttttagt acagacgggg tttcaccatg ttggccaggc tggtctcgaa
58321    ctcctgacct caagtgatcc acccacctcg gcctcccaaa gtgcagggat tacaggcatg
58381    agctaccgtg cccgacctaa ttattattat tattatttga aaaatagtaa gcacagggac
58441    agcctgccag gttccaatcc cagttctcca tgtccttgct gtgtgagcct ggacacatta
58501    tctcctactc tgtgcctcag tttcctcatc tgtaaaatgg gcttcccaat acaacagttt
58561    ttttttcttt gaaaatttga tttattgatt tttaaaaga gatgggagtc tgggcaatat
58621    agggagaccc cgtctctaca aacaaaaaaa atagccagga gtggtggtac aggcctgcac
58681    tcccagctag ttgggaggct gaggagggag gatggcttgg gcctgggagg tccaggctgc
58741    agtgagccat gattgcgcca ctgcactcca ccctgggtga cagagcaaga ccctgtctca
58801    aaaacaaaca aacaaacaaa agcaaaaaaa agcagccagg catggtggcg gctcactcct
58861    gtaatcccaa cactttggga gggcaaggca gatggatcac ctgaggtcaa gagatcgaga
58921    ccatcccggc caacatggca aaaccccatc tctactaaaa atacaaaaat tagccaggcg
58981    tggtagcagg cacctgtaat cccagctact ccagaggctg aggcaggaga atcgtttgaa
59041    tccgggaggc agaggttgca gtgagccgag attgtgtcat tgcactccag cctgaacgac
59101    agagtgcaac tccatctcaa aaaaaaaaaa aaatattgtt tggcggcat gattaaaaaa
59161    gtcataatta taattttttat aataacaata aataggtaaa aattagagct ggggggtcata
59221    ctatgttgcc caggctggtc ttgaactctt gggctcatgc aatcctccca ccttggcctc
59281    ccaaagtgct gggattacag gtgtgagcca ccaggcccag cttcccaaag cttttttttt
59341    ttttttttta aggggatgga gtcttgctct gtcacccagg ctggagtgca gtggtgccat
59401    ctctgctcag tgcaacctcc acctcctggg ttcaagcgat tctcctgcct cagcctccca
59461    agtagctggg attacaggtg cccattacca ttcccagcta gtttttttt ttttttgag
59521    actgagtccc actctgtggc tcaggctgga gtgaggtggc gctatctctg cttactgaag
59581    acttcacctc ctgagttcaa gcgattctcc tgcctcagcc tcctgagcag ctgggattac
59641    aggcacccac tacaacgccc agctaatttt ttgtattttt agtagacatg ggtttcact
59701    atgttggcca ggctgatctc aaactcctga cttcaggtga tctgctcgcc ttggcctccc
59761    aaagtgatgg gattataggc gtgagccact gtgcccggcc tccccaggct tttgaatgag
59821    cccatacaca taaaatactg cctgttaacc tcttattgtt gtcactacca acaaatagta
59881    gctgttagca ttattgggaa aaatcaccgc agccgcagct gcagcctaag caaggccagg
59941    cctgattcct aaagagacca ggtctcacat tgggagtggg gagccactga gtcaggagcg
60001    gcaggactgt atctggcacc agctcaagtt gtcaaccaga gactgggcca cgtgtaacgt
60061    agagcacagg tgagggtcca caccgacgcc agRgagcacc cctacctccc acactggtgt
60121    ttgcgttgta actgggagaa agggcggcct ggccccagcc ggcccctacc tgtacgtggg
```

FIGURE 1-Q

```
60181   gatgatctgc aggctggagt ccggctttat ctgaaacttc agagtcaccc cctcgaaccc
60241   agggtccact ctctcggtgc cccggcaggg gttcagctgt ttccggggcc ttctctgggg
60301   tggggccgag ggagtccccg ggggctgcag acggcggccc ttttggctga tcctggtctg
60361   tgtgtccttg gaatccctgt ccagcagcag gcggccctga gtccccagag ccatcgggtc
60421   ccagcaaggc cccaggacYg gggtgtcctg ggcaggggac tgacccagcc tctccactgt
60481   ctcttggagg aagcacaggg cggtgaccga ctcctggcat gcaggccaga gggacctggg
60541   gagaagggca gtggggtcac gttttcttgg gtgactcctg ggtttagccg gccaggggt
60601   tccaacttgg gccggctctt tgtgtaccct tggacaggct acacaccca cctgaggttc
60661   agtcatttct aactctgggt ggaaggttta agagttgcag taattgcaac tcacctcgcc
60721   cactgtgggc ctcccaggca cgcccagccc tccacatcaa tcaacccctt acggcacccg
60781   tagatcaccc aggcagggac cgccctaggt gaccgaggca ggatatcaag cctctggctg
60841   caggatcgag aaaaaggtta ctttttttct ttgtgtttct tttagagacc gagcctcact
60901   ctgtaccccc gcctggagtg caggggcgtg atcaggactc agtgcagcct agaactcctg
60961   ggctcgaccg atccttccgc ctcagcctcc cgagtagctg ggacttacag gcacgcgcca
61021   ccacgccgct ggcttgccat aatatgatta cgattttat catttcatt attattgagt
61081   tgccctccat aaccctgga tgatccctgg ggagtgccta catcagcccc agagacatgg
61141   aattgcatgg cctctgatcc ctagatgacc ccaagtgtct ctgggcacca gaacctcttt
61201   gtaagtttca gtaactatta taaaattgcc acttctcgat aaccccagca aagagaggtc
61261   atgacccctt gatcactgag ccaggtggtg aagtgctagc ggggtccggg gaatggggtt
61321   tggccttacg cacctctcac tgattctgca gcatcctggg gtcctcggct tctcctggga
61381   ggggatcct cccagccgct ccaggttcag acagggcggc gccagaagct ttgctggcat
61441   tgaggagtcc gggattggct cggcctccat tgcgcccag cccagccccc tccctaattt
61501   cacccggccc tgtcccgctg gcccacccg atgaaaccca cctgggaggg gcgggacctg
61561   tgtggtggga gcgctcttgg tagaggatgc gatgagcccc agctgagagc gaccagcctc
61621   ggcggcacct ttcctctttc tggctttttt caggtcatcc gcgcacccct gcgtggcaag
61681   ggcggcctgg accccaccaa atccctccgc agctgccggg gcggggcctt ccacgctagc
61741   cctccccctc ggaaatgggg gctcccaggc ctctgccttg gatcccagc ggcatcttag
61801   atcccagagg gaaaagagaa ccggggcccc agcacagcag atgcaggtgt ggtttgtttt
61861   tgttttgtt ttttttttt ttgagacagg gcctcactct gtcacccagg ctggagtgga
61921   atggcctgat caccgctcca ctgcagccta aatcccctgg gctcaagtga tcctcccacc
61981   tcagtctccc gagtagctgg gactacaggc acttaccacc acctccacgct aattttact
62041   gttttttatag agacgaggtc tcgccatgtt gcccaggatg gtcttaagct cctggcctca
62101   agtgatcctc ccatcttggc ttcccaaagt gctaggatta caggtgtgag ccacctgtag
62161   accccagatc tgtcccccaa ggacactcaa catgctgggg cctgtgttat cgatttattg
62221   cagctccaat atgagtccac tcctactcaa accctgattc tcaggggcct ggggaaggcc
62281   accccactag gggccctgtc cccaccagag cctggacatg ggactctctc ccaagcaggg
62341   gtgttgtcct tcacaggggc ttccacgtct ctcccgggcc tgtccgcact ctgggcaggg
62401   ctggcacctg gctattccct caatctgggc cctggggcca tggcaatgtg gaatggtcca
62461   ggtgttcatg tcagtggggc ttggggacat ggccatccac gtagaagttc ctggtgatct
62521   tgggcagggt gaattccgct ccttccagct ccggtgtcag cacaatctgg cagcccagcc
62581   gcgagttctc ctggaggagg ggggccatgt ctagcatgtc gtcttcccta gggtggtgac
62641   acgggcagtg ttagccgagg gcaagctagc tgggtgggtg ggggccagga ggtSggggag
62701   ggaggaagct gactgagcgc aggggggtagt ggtggggag gcagctccca ttccaggaac
62761   tggaagtggg gaggatggtg gggggctgctg aatgctccag ggtgaagctg ccagctagac
62821   agggctgacc cactcacctc tcctcggag gaggcaggag atccaggtgg tcttcactca
62881   catacacatg gcaggtggag caggccaggg aggcttcaca ggcccctagg ggtgggaagt
62941   gaagggggcg caggtgagtg gcagagtcag gaaggggctg ctatgcgaat ggcgtagagg
63001   agtagacctc tcttccacca cgtgcctcac gtctccctcc tgggcctgca gctccactgt
63061   gtgtaccagg cactgtgtca tgtcctcaat gtcctcagct agctgttccc cagtgtgtag
63121   ggtttacaaa cggacatctg ggaggcccca tttcccaggg actccctagc aggctgagat
63181   gcagaaccat taaggagcag ggacttggct gccaggtagc tgagaggga aaggccaggc
63241   aggctccccg cagtctgtga gcccttgctg tgaccctatc actgtgctgg gctaatgtgt
63301   ccccacctct ccactgctct tggaggatgg accggctgac tcagcagtca gtgtggtggg
63361   ggaaggaatc aggcattagg attttgtttt ttttttttt gagatggagt cttgttctgt
63421   tgcccaggct ggagtgcagt ggcacgatct cggctcactg caagctctgc ctcccgggtt
63481   cacgccattc tcctgcctca gcctccaag tagctgggac tacaggtgcc tgccaccacg
63541   cctggctaat ttttttatat tttttagta gagctgggt ttcaccatgt tagccaggat
63601   ggtcttgatc tcctgacctc atgatctgcc cgcctcagct tcccaaagtg ctgggattac
63661   aggcgtaagc cactgcaccc ggccaggatt ttttttttt tttttttgaga cagggtctca
63721   ctctgttgcc cagcctggag tgccatggct cagtcatagc ttactgcctc aacctcccgg
63781   ctcaagcgat cctcccaccc cagcctcccg agtagctggg actacatgtg cgcaccacca
63841   cacctggcta attttttttt ttttttttt ttgaggtgga gtttcgctct ctttgcccag
63901   gctggagtgc aatggtatga tctcggctca atgcaacctc tgcctcccag gttcaagtga
```

FIGURE 1-R

```
63961  ttctcctgcc tcagcctccc aagtagctgg gattacaggt gcccaccatc acgcccagct
64021  aatttTgtat ttttagtaga gatggggttt tgccatgctg gccaggctgg tcttgaactc
64081  ctgacctcag gtgatccacc tatctcggcc tccctaagtg ctgggattac aggtgtgagc
64141  caccgcacct ggccatattt tttttttttt tttttttttt tgtagacg aggttcacca
64201  tgtggcccag gctggtctca aactcctaag ctcaagcaat ctgcctgcct tggcttccca
64261  aaatgctggg actacaggca tatgccactg caccagacca ggaattaggg ttgaaagaga
64321  cagaacctga agttttctgc tgaccacctg ccttggtca cacccccaca tcctctgatc
64381  acagagaccg gtgcttgggg atcatgtccc tcctggccta aaactttcca aagggttttc
64441  acactcagaa taaaatccaa actccttcac ttagtcttgc agttccccca tcccccctcat
64501  tcattccttt gttttccttt gtaattttt tcttagagat gggagtcccgc tctgttgccc
64561  aggctggact gcagtggcgt gatctcggct cactacaagc tccgcttccc ggattcacgc
64621  cattctcctg cctccgcctc ccagagcagc tgggactaca ggcgcctgcc accatgcctg
64681  gctaattttg ttttttgtatt tttagtagag acagggtttc accatgttag ccaggatggt
64741  cttgatctcc tgacctcgtg atccgctcgc ctcagcctcc caaagtgctg ggattacagg
64801  cgtgagccac cacaccttgc caggccactt acctctacta gcccggcaca gtggctcatg
64861  tctgtaatcc cagcactttg ggaggccaag gcaggcagat caactgtggt caggagtttg
64921  agaccaccct ggccaacatg gcgaaacccc atctctatta aaaatacaaa aacttagccg
64981  ggcatggtgg cagttgcctg taatcccagc tactcgggag gctaaggcag gagaatcact
65041  tgaaccctgg aggtagaggt tgcagtaagc caagatcatg ccattgcagt ccagcctggg
65101  tgatagagcg agactctgtc tcagataaat aaatgaacaa ataaatctat ctcacattcc
65161  aatccctgtc ctagactatt ggctgctgga ttccagaaca gaactttagg taggcctttc
65221  ataacccctc ccaacatatc ttcccctta atgataaaat caggatccct gatatattca
65281  tcccaaaagc aaaccctata tattttcttc cagacaaccc ttcccaagtt ggtcataatt
65341  atgtatttac ctgtgggatt attgtcccta ttagaccgaa atggatgtga gatgacagag
65401  gcctatttg ttttgtatat tgctgcctga cgcgcagtag gtattcatag aaaggcagca
65461  cagattagtg gctacaatgg actggtgagt ctagtattgt cactcacttg cccttagacc
65521  aggtctactt aacctggggt ttagttgcct catctataat agggaataac agtctctact
65581  actcaagttg tcatgaagat tcagtcagtg aatatttatt aacatggtta aagacatata
65641  tatatatata tatatattt ttttttttt tttttttttt ttttttttg agacagtctc
65701  actctgtcgc ccaggctgga gtgcagtggc gtgatcttgg ctcactgcaa gctccacctc
65761  ccgggttcat gccattctcc tgcctcagcc tcccgagtag ctggactac aggcgcccac
65821  caccacgccc acctaatttt ttgtatttt attagagacg gggtttcacc attttagcca
65881  ggatggtctc tatctcctga cctcgtgatc cgcccgcctc ggcctcccaa agtgctggga
65941  ttacaggcgt gagccaccgc gcctggcctt ttttttttgt ttgtttgaga cagagtcccg
66001  ctctgtcatg cagcctggag tgcagtggtg ccatcttggc tcactgcaac ctctgcctcc
66061  caagttcaag tgattcttgt gcctcagcct cccaagtagc tgggattata tgcatgtgcc
66121  accacgccca gctaattttt tgtgtttcttg tagagacagg gtttcgccat gttggccaga
66181  ctagtctcaa actcctgtcc tcaagtgagt cgcctgcctc ggcctcccaa agtgttggga
66241  ttacaggcat gagccactgY gcctggacaa gaaatttcta ttattatttt tctctcaaca
66301  aattatcaaa catctgttac atcttgacag gcaacagata agcatgaata aggacatggg
66361  tcaccaatct cactgggggga cagatgacaa agtaggaaac aaaacagcct ggcattgtgg
66421  cttgtgccta taatcccagc tacttgggag gctgaggtgg gaggatcact tgaacccagg
66481  agttcaaggc tgcagtgagg tatgattgca tcatggcact ccagcattgg cgacacagca
66541  aggctccgtc tcttgaaaaa aaaaagtga gaagtgctat atatcatatc acactgataa
66601  gacagagtaa ctagggcatg ggtacttcag ctggcgtgag gggaatggga ttgttagga
66661  catgacattt acactgaggt ctgaaggatg agaaagagcc agaatgtttg ctgggaaagc
66721  acttcagaca gagggaacag caaatgtaaa ggccccgaag caggaatgag cttggttgtt
66781  tgaggaacca caagaaagcc agtgtgggct gggcgcggtg gctcatgcct gtaatcccag
66841  cattttggga ggctgaggcg ggtggatcac ctttcaggag tttgagacca gcctggccaa
66901  tgtggtgaaa ccccgtctct actaaaaata caaaaattag ctgggcttgg tggtgggcgc
66961  ctgtaatccc agctagtctg gaggctgggg caggagaaac gcttgaaccc ggaggtgga
67021  ggttgcagtg agctgaggtg cagtaagcca ttgcactcca gcctgggcaa caagagtgaa
67081  actccatctc aaaacaacaa caacaaaaag aaagccaatg tggctagaat acagggagga
67141  agggggaaga gaacacaaaa tcctgggagc caggagtcct agtgatctct aataaatgct
67201  taacaaataa gagcttggca acagatgagg ccatggtgag gggtttggat tttagtccat
67261  atttggtggg aaaagacgt gaagagacac acctRatttg tggKttTttt tttttttttt
67321  tttggacaaa tgtataagga cctccttaat tccctctgcc cggttcctac cttccaggtc
67381  caccccgtgg cgctgggcca ggtgaagaac attgtccccg actctgccat tcactgggat
67441  ccgctggcct gagcggttcta cgaacaccac gttcacccctg gggacagatg gaagtgcgaa
67501  tgccgaactg gatgatgggc tcagggcccg ggtagaatct aggtaggga agtaggaatt
67561  gaggcttgac gcacaggtac tgaataggc aaagcagaag ggggacctcg agatgaagct
67621  acagggcaag atggggacca gaggaattcc gtgggatgag aatgggggg cttggccccc
67681  tgcactcaca cgtccccggg ccgctccggg ccgcccgcgt cctcctctcc Mgccgggcgc
```

FIGURE 1-S

```
67741   gagcctggaa aacacggttc ggtgagcggc tgcgccgagc cccgccccgc cggcatctga
67801   cggattaacg ctgcccgccc cgggcgcccc aggtacctgt cgcttgaaac tttctggttg
67861   tccccagcgc caccccctcc cccgacccgg aagtgccccc aggtctgttc caccaggtgc
67921   ccctggcagc ctgcagtaga accctggcac tcacgcctcc ccgggccatg gaggcggcca
67981   tgacatgcat cacgtgactc accgactgag catgcgccgc gccagggagg cgagggaaag
68041   cccataatca atggaacata agcgcagatg tttgcttagg gcctgcggtg accaggtggg
68101   aagagcaggg cggaatccat ctcaggtaaa cccgcggggc catcccagac ctcccactca
68161   agcccactgt ttgtcccaag aaccagccaa ctctgatttc tttaaaacca tttacttaca
68221   aactttaatt cagcaaaggt ccgtgtgggg agactggggt ggggtcgggg gaatagtccc
68281   cttggagtgg atgtggaccc ccagagtcaa gggagggaag ctggtggccc agttggctgg
68341   gggcaaggcc cagggtcacc tcaggtcgac aggtcctgct ggtgggcggg cccagagttt
68401   atcttcatgg agtgctggtt tctggcactg gctggaagg aggccagctc cagggatctg
68461   gccgggggtg ggcaggcaga attcaagaat tcatcttcaa caagcgagtg acagcagagg
68521   ctccgggaga tgggcacaat gtccgactcc cacaKacaga cagcagggga ctggcagaga
68581   aagcccatct ctgcacggag gcccgggtag gaggggggtgg tggggccggt tcgccaagat
68641   gaaggctttc cccttctact gtccccaggg tggagatcct gggtagggtg cccaatccc
68701   taggccagag ctgtttggtc catagtcaag ctcccagagc ttggcatctg tggctctggc
68761   cagcagggcc tgggcccag cttttaaggc atcagaaggg gaggggcctg cggcagggac
68821   cccgggcccc acggctgggg tataggccag atgggcaggc aggggcagga gacagccatg
68881   cctgcagcaa atgtgggaaa aacagctgtt tcaaaccgca aggtgtggaa tggtggcccg
68941   gacaggccgg gccttgaagg aatcagagct ggggctgtc cggggtggtt tgaaaaataa
69001   aacttagaaa aggaaacaga agtcagttgt caaagttaaa aaaaaaggag acagtctctg
69061   tatcttcacg ggaggtcagg gaaacctcca aggcactcga aaggccaaaa ttacaggagc
69121   aatgaggcag gagggctccg gagagacggg cacagcggag gaggagatgg ggggagggag
69181   ggagagcagg ccggggcccc tctctcttaa ggctgcaggg tttcagcgtg gggagcaagc
69241   cagagacata atgaggcctc cagactcccc cacacccctt gggctcctgg ggctccggct
69301   gattggtcag taaagtcttt cagagatttt tctattaccg aaagagagaa aatggtttaa
69361   aaaaaacaca aaacaaaaca tcagaaaacc caaaagcgat ttggtgcagg cccttgagtt
69421   atctctggtg ccagccactt agaaaatcct cttccgcttc aggtaggagt ccgcgtagtg
69481   gccgccgagg ccctgggagt gctggcccac atagctgcct tctgggctgg gctcgggcga
69541   gggcagcagg tgggcaaagc tgcgtttctg gccgcccagt gggggtctgga gacagagggc
69601   agggcgggc gggtcagggg ccgctgggg gccggggctt cccagccctg catgtcccca
69661   cccccctgccc gtaccttcag caggtggctg tgaccattag gcccggggct gagcccagg
69721   agcccttctc cggaccccag cggggaagag ccgattgcct gggagaaatg gagaggtgga
69781   acaggtcact ccctgggggc cagaggaagc acccacccccg ccccccctgcc actgcccccc
69841   agccctgagg gaaagcgaac agtttcaggt tcaaatcttg cttctgctac tttctagcta
69901   taagacctag ggccaattgc tccattttat ttgagcctcg gttttctcat ctgtcagatg
69961   gggccagtag cacccacagc ctgggctgta gagagaggaa gtgacagaaa gcccggaatg
70021   ctggcagtgc taggtgcttg atgcagagtg gatggaggac aataggctgt tgctactcca
70081   ccctgagcaa gaccaacccc tgccaccacc ccagctttgg cctgggcacc gagggttaca
70141   gagccccggt ggcaggcacc cccaaatcct agctgtccca ggggcctgt gcttggccag
70201   agaggttcct caccttactg aggtggctct gcttgaggcc agcctgcagg ccgctggtga
70261   agtaggaagt gggcgagcct gaatagaagt gagacagggg gccccgcca ctcccaccgc
70321   tgctccgttc gccgaagcca cggcccgggg gggacatctg tagaagaagg gccggtggag
70381   tgaagcagac aattgtagta cccagcccct tgtatacaat cttccctcYg cctcccaggt
70441   tcaagcgatt ctcctgcctc agcctcccga gtagctggga ttacaggcat gcgccaccat
70501   gcccagctaa ttttttgtat tttagtaga gacggggttt ctccatgttg gtcagactgg
70561   tctcacactc acgacctcag gtgatccgcc cacctcggcc tcccaaagtg ctgggattac
70621   aggcgtgagc caccatgccc ggcagttctg ggctttgcaa agactagctt ggctaatag
70681   gactgaggag agctggcacg tgggtacccg cctcctcttc ctcctccagg aacccaggga
70741   tcatcaccgc acgaatgggc acacagaaac tgttccagcc tgtggacgcc aaatatgtga
70801   ggccacatag ctcactgaga cccaggtgag tgccggggac cgcccactgc cccatagagt
70861   ggcaagaagt aataMaatgc ctggcatggt atggtggctc atgcctgtga tcctagcact
70921   ttgggaggcc aaagtgggag gattgcttga gccaggagt ttgaggccac agtgagctat
70981   catggagcca ctgcactcca gcctgggcaa cacagtgaga tcctgtctta aaaaaaccca
71041   caaagaacac acaaaataca aggtctgctg ttccaggcta ctaagtcatg gcacagcctg
71101   tcatgtagta aaagctgatt gctacacatg ccataccagg tggctcttac ctttgtgtcgg
71161   ctgggtccgt gaggcccaag ggctggttcc cgtggtgggg agaagagccg ccgaggtccc
71221   atgtcctgaa tgaaagcggg agaagcacat tgggttggag tctgtcccag cctcaccccct
71281   ggctgaactc catggcagag ctgtcatcag ggaagacagt ccccaccact ctgggaccag
71341   gaagaggcaa atttggggct ggatgcagct tggcagggat ggctgctgtg aaggggggtg
71401   cccccccatgg gcctaagtgt ttggagtttc ccaggcaagc tggaattcg agctgtgtgg
71461   actcttgcag tttttcctgtg ttggcgttag ttcctgttgt tatttgtttg aaacacagag
```

FIGURE 1-T

```
71521  ggggccaaac atcacccagg tgacctgtgg gcggccagtt tgcaatttct ttcttttttt
71581  tttttaaacg gagttttgct cttgttgccc aggctggagt gtaatggcac aatcttggct
71641  caccacaacc tccgcctccc aggttcaagt gattctcctg cctcagcctc cctagtaact
71701  gggattacag gcatgtctac cacacctggc taattttgta ttttagtat aaaacataaa
71761  ttatatttta tattatatat gaaatatata ttttattata tattttataa tatataattt
71821  ctccatgttg gtcaggctgg tcttgaactc ttgacctcag gtgatctgcc cgcctcggcc
71881  tcccaaagtg ctgggattat aggcatgagc caccgtgcct ggcccagttt gcaatttctg
71941  acctgccaag gaggttggca tcatagaagg accaaatctc caggggcaca gacaggaatc
72001  aaaggtggga gagagggata gaaagggcaa gccctgtctc tggggagaga cagtgtggcc
72061  taagtcctct tgggagagaa agacagacgc aggatgacag acagactgag acccaagatc
72121  ctccagggct cgagaatgga cagacaggca ggtggaccgg aagcaggggg tgatgtgcag
72181  acagacggga aactttaagg gcatgaggct gggcgcggtg gctcttgcct gtaatcccag
72241  tactttggga ggctgaggcg ggtggctcac ttgaggtcag gagtttgaga ccagcctgga
72301  caacacaatg agactccgtc tctaccacaa atttaaaaat tagctgggca tggaggtgcR
72361  tgcctgtggt cccagctcct caggagactg aggtgtgagg atcgcttgag cccaagaggt
72421  tgaggctgca gtgagctatg atcgcaccac tgcactccag ccagggcagc agagggagac
72481  cctgtctcta aaaaaaaaaa aaaaaaaag cagagaccat atctggcacg ttccctgccg
72541  cctccctagc acatggcctg gcatagtcaa tcctagagaa atatcagttt ggagaatgat
72601  ttggccttag gggacagaga gctgcagcca ggcactcacc gaggggtagt cgaagctgta
72661  gctgtcagac agtcctggtt cgggggggcag gcgggcgctg ctgaggggc tgagcaggcg
72721  ggacttgagc tggaaggctt tgctgctgct gctgccacct ccaggggctg ggggggttagt
72781  tgggggggccc tcagctgggc ggcggcttct cccggcgcct ccccagcccc gggcctcctt
72841  acccgccagg ttgctggccg ggagcaggct gtgtaggttc aggtagggat tcaggggaat
72901  ccggtagtcc ttgggggggct cccccagcag tgagacctgt ggcgggaagg caggattcga
72961  gagggcccc gggagaggga accctgcgga acaggaggct ggtgtggtgc cgcgcgcagg
73021  gcagggcctt accccagggg gcgtcggcag aggcccactg tctttctgga ggcctctgag
73081  gccagagcct cggagcccca caggggcggg ggaggagtg agctgggccg ctgggggacc
73141  caagcccagg gcctcccggt caccccagc agggccaagc acggatggca gcaggggtgg
73201  tggcttccct cgccggggcg gcagctccgg gggcaggccc cctcctaggg agggaaggag
73261  gatttcaggg gcccaggctc acaggacccc tctcccaggg gccctccagc tcccacctgg
73321  accagggccc aggggtcaag agacaaatcc atgctggcca ctgagcagag ctcatccctg
73381  ggccctgagt ggagggcacc caactgatgg acaaggcgc tgggacccag aggttgggtc
73441  actcacccga ggccacgtag cagggaagga aggggaagtg gctgggggac accgtgtggg
73501  cagggtctgc gttacctgca ggcagctccc cgaggagggg gttggctggc tgggccccag
73561  gctggagggc gcccaggggt gagtctccca ggatgccggg cttctaggga cagagcacag
73621  acagttgcag atggggggcag ggtggcccag ggaagcagac aggtgtggcc cagagtcttg
73681  gcagacacac cccaactcca gggcacggcc gatcctgggc agacaggcac agggttcccc
73741  agtgcccgcc acactccaac tctatcactg tcccatcagc catggtgacc gagggtctcc
73801  tgagctccag gccccagttc cctggccaat gattgcagca cagtatcaac tgcagccaca
73861  tggaatggga cagccacaca gtgtttcagc cacttttagt cacagaaggc cagacccaca
73921  ggctcacata ttctgtcagt taccaccaga cagacacacc tgacttagaa tccagggaac
73981  cacaccagac aggacggagc atgggtgtat gtctatgtgt gtgtgtgtct gtgtgtgtgt
74041  gtgcgtgtat atctgtgtct ttgtttctgt gtgcatgagt ctgtcttgtg tctatatgtg
74101  tgtctgtgtc tatgtgtgtg tctttgtctt atgtctttgt gtgtctatgt ctctgtgtgt
74161  atatttgcat ctttgtatgt gtgagtctat atgtataccct gtgtttctag gtgtgcgtgt
74221  gtgtgtgYgc acacactgag gggatagacc tggagttttt tcccaggcat gtctatagag
74281  cttccgagca gagtctattc acaaactggt gcccagcagc ggcgctccca gcccacaccc
74341  agtttcaggc tgtaaatggg cgtgtccagg tccctgacc ccacccagg caccaagtcc
74401  aggggcgctc tcagaatgga gggaaagatg gcgaaccatc atgagcaatt gccagagggg
74461  gatgggggatg tgggtgggaa aggcagggt ttgggggagt cgccctcacc ctggttctgc
74521  gcccccaggg cacagccaga ggtcccccca cccaccgat cgcaccagct gtgttgaaaa
74581  gagcctgtag gggctgtaga gcagtgggtg aggggatgc gtgtgttacc ttctggccct
74641  gggtctgcag ggcgagctgc aacagcgccg tggacagggc tgcccattg agcagcggca
74701  tggctggggg ggcacccagg aggcctggag ggagacatag gaggatgtgt gggggtccct
74761  gtgtcctccc tgccccacct cacgaaacac agcctgaac ccattgatgg ggcaggaaac
74821  tgacactctg gggccggggg gtgggcagtg gacttgccca aggaagggc ctagaagggg
74881  cagaggctac tccagtgaag gtcagccccc tcttgtcagc accccacctc actgcaggct
74941  gctgtgtggc cctggtcccg gccccagtt gtggacagca gcagcccccg ctatgactcc
75001  atactccccc tcggccctac tcctgggggct cctgtcactg cagccaagat gagcagtttc
75061  gggagtgcc gggggcagcg ctgcagcccc tgttctgcac agtgggggccc ctgtccagcc
75121  ccaccttacc ctgcttcccc cccgcactgc catggagcag gggggttgagc agcagctgga
75181  gggacgcgga tgggcccagg ttgttgagca gctgcaggat gttgggctcg ggaggagtc
75241  ccttccccccg attgagggcc tgcaggaagg aacagaagca gctcagagtg ccgctggggc
```

FIGURE 1-U

```
75301  cctgacatcc ccatggggct cccatccca ccccgccacc tctgcccgca caggctcacc
75361  gtggcctggg cagcgatgag agcggccagc atactgcggc cgggggcccc aggggcgcag
75421  aaggagactc gcaggtggct gcccccagg gacaggccgt ccgcctgctg ctgtgcctcc
75481  tccgccatct cagccgtctc atactccagc accgcgaagc ccttcagctg cccatcctgg
75541  ccgcacgcca gctgccggag gaaggcaggc agtcatgagc atctgggcag cagtgactgc
75601  accaccccgg gaagtgacaa ccgtaaccag actcagctgc cccataaggg tgaactccac
75661  gccaggcctc cactgccctg tgcctcattc ctgcatcagc tcatctgatt ttcccaatga
75721  ccctgggagg ctgcatcata cccatttctc agagaaggca actgaggcac ggagaggtca
75781  gcgcacccaa ggccacacag ctggagggag ggcggagctg ggagccacct caccaacaaa
75841  gccaaggcca cgggcggatg cggtggctca cacctgtaat cccagcactt tgggaggccg
75901  aggcgggcag ataacctgag gtcgggagtt cgagaccagc ctgaccaaca tggagaaacc
75961  ccgtctctac taaaaataca aaattagcca ggcgtggtgg cacatgcctg tattcccagc
76021  tacttgggag gctgaggcag aggcaagaga gtcacttgaa cctgtgaggc agaggttgcg
76081  gtgggccgag atcgcgccac tgcactccag cctgggcaac aagagcaaaa ctccatctca
76141  aaaaaaaaaa aaaaaagag ataatcagca acgggtgggg aaggaagggc tctcgttcca
76201  gacagtggcc aagccaggta gcagtgctaa gggaagtggt tgggctgggc accggcactt
76261  gctgaatgcc cgggcagcaa aggtgcaggt agcagccctt cacctctgcc cacgccctgt
76321  gccaaggtct gggcacagat ctcccataac caaacctgtc ggcttttgtt ttgttttgtt
76381  tttttgaga cagagtcttg ctctgtcacc ccggagtgca gtgatgtgaa cttagcttac
76441  cgtaacctcc acctcctggg ttcaagtgat tctcctgcct cagcctcctg gtagctggga
76501  ttacaggtgt gcaccaccac gcccagctaa ttttgtatt tttagtagaa atgaggtttc
76561  accatgtcgg caaggctggt cttgaactcc tgacctcaag cgatccgcct gccttggcct
76621  cccaaagtgc tggattacag gcgtgagcca ctgtgcccgg ccataaacac acccatctta
76681  gggatgaaca gagagagact cagaggggtc acagagtgat caaggccaca caattcctaa
76741  gtcgagggac tgatgtgtga acctcaagct gcttcactgt caagcccacc ctccattcag
76801  cYgggtcacc taacattaaa ggtgggctcc tcggaggaca tcacttcaac gcctgctact
76861  catcagatgc tcaacaaatg tttggtgaga ccaggcccag tggctcgaat ctataatccc
76921  agctctttgg gaggcaaagg caggaggatc gtttgagcac aggagtttca gaccagcctg
76981  ggcaacatag ggagacccca tcttcacata atttttttt tttttgaggg agtctcgctc
77041  tgttgcccag gctggagtgc ggtggcatga tcttggctca ctgcaacctc cacctccctg
77101  gttcaatcaa ttctcctgcc tcagcttccc gagtagctgg gattaaaggc acctaccacc
77161  acgcctggct aattttttt ctatttttaa tagagacagg ttttgtttt tttgttttgt
77221  ttttttgag acggagtctc gctctgccac ccagactgga atgcagtagt gggatcttgg
77281  ctcaccacaa cctctgtctc ccaggttcag gtgattcttc tgcctcagcc tcccaaatag
77341  ctgggaccac aggcacatgc caccacacc agctaatttt ttttttgta ttttttaatgg
77401  agataggggtt tcaccatgtt agccaggatg gcctcgatct ccagacctcg tgatgcaccc
77461  acctcggcct cccaaagtgc tgggattaca ggcgtgagcc accgtgccat gagacagggt
77521  tttaccatgt tggccaggct ggtttcgaac tcctgacctc aagtgatctg cccgccgcag
77581  cctcccaaag tgctgggatt acaggcatga gccactgtgc ccggcctcta cataaaattt
77641  taaaaatcag ctgggcatgg tgaYgcattc ctgtagttcc ccagctacat gggaggccaa
77701  ggtaggagga tttcttgaac ccaggaggtc gaggccggag tgtactcctc cagcctgggt
77761  gattgagaac ctgtctcaaa aaaaaaaaa attaagttta gtgaatgttc gagtggagga
77821  atgaatgggc agctgttcac aacaacctga tcatgaagca ctgccagccc cattttgaga
77881  tgtggaaaca ggctaggaga gtacctgtag ctggtcatga ccctgtgacc tttgatctcc
77941  acataagaag gtaaggccag gccagcgcag tggctcacac ctgtaatctc agcacttggg
78001  gaggccgagg caggtgtatc acctgaagtc aggagttcaa gaccagcctg gccaacacgg
78061  cgaaacccca tctctattaa aaacacaaaa attagctggg tgtggtgtca ggcgctgtca
78121  tcccagctac tcgggaggct gaagctggag aatcacttga acccaggagg cggaggatgc
78181  agtgagccaa gatcgcgccc ctgcactcca gactgggtga cagagcaaga ctctgtctta
78241  aaaaaatata aaataaaata aaagaaaggt gaggccattg tgctaactca tcttctgtcc
78301  tgagcccgca caggcggcct ggtacatagc aggcctggta cgtagcaggt gtccaagaga
78361  aagcagcaga atggatgaat gataagtaaa cagagagggg gttcccgtgg ctcatggata
78421  ctcagttttt gttttttttg tttctttgag acggagtctc gctctgtcgc ccaggctgga
78481  gtgcagcggc acgatctcca ctaaccgcaa ccgcagtctt ctgggttcaa gcaattctcc
78541  tgtctcagcc tcctgagtag ctgagattac aggcgcgtgg cgccatgcct ggctaccttt
78601  ttttttttgt tgtattttta gtagagacgg gatttctcca tgtttgtcag gctggtctca
78661  aactcctgac ctcaggtgat ccgtccgtct cggcctccaa agagctggca ttacaagcgt
78721  gagccactgc gcctggcctg ttttttttt ttttttttt tctgttttg agatgcagtg
78781  ttgctttgtc acccaggctg gaRtacagtg gcgtgatctc agctcactgc aacctccacc
78841  tcccaggtac aagcgattct cctgcctcag cctcctgagt agctggatt acaggcctgc
78901  accaccacac ctggctaatt ttttttgtat tttagtaga cagggtttt caccatgttg
78961  gccaggctgg tcttgaactc ttgacctcaa gtgatccacc tgcctcggcc tctcaaagtg
79021  ctgggattac atgcatgagc cacctcaccc agcctgtttc ttgttttaaa tatagagatg
```

FIGURE 1-V

```
79081   gtgtcccact atcttgccca ggctagtctt gaactcctgg tctcgagtga tcctcctgcc
79141   tctgcctccc aacagacacc tagtttaaat ggggcaccaa tacccactt acacgagagg
79201   gacccactca agcccacaga gctggggtc cgagcccagg actgtctctc tgttttgag
79261   atRagggtct agctctgttg ctcaggctgt agtgtcatgg tgctgtggtg cgatcatggc
79321   tcactgcagc ctcggactcc cagaatcagg caatcctccc acctcagcct cctgagtagc
79381   tgggactaca ggcacaccat catacctatc taattttgt atagagagga tttcaccata
79441   ttgcccaggc tggtctcgaa ctcctgggct cgagggatcc gcccgcctca gcctcccaaa
79501   gtgttagggt tacaggtgtg agtcactgca cctggccagg cctaccctt taagcctct
79561   gcactggcct ccgctcactg gcccaagctc tggagctagg ctgcggtgtt ctgatcccag
79621   ctctgccaga ccctggctgt ttaactctag gcaagttact tgacccctct gtgccttggt
79681   atcctcacct gaaaatggga gtgatacctg cctctcaggg ttgctacagg atgaagcaac
79741   tgaaggttac gtactcagag tccacagcga gtgctggggg aatgtcccct ttgggatctc
79801   tggggatcaa gaccttctgg gggctcttag agagtgagtc tggcctgttc tcgcccact
79861   gcacctgtta cagggcgagg cacacacaca gaagtgcctg catgtgtgg cttgaatgaa
79921   caagggactg ttttgccaac ccattgtgca agtattgagt ccctgcttat ggaggaggga
79981   aactgcagat cagagagcca gtgactggcc cgagctcgag ggcggggctg ggatctggca
80041   aagcctcagt ctctgacctc aaggctcaaa tagactgtgg gctcctctgc agcctcctca
80101   atgcctggtc caggtctggg accccatggg aggtttgacg agggtaccag cgaatgagga
80161   ggtgagtggt gagcaagcct cgagatccat agttacaaga gtggccttgc atgcatctga
80221   tagagggaca gtgaggcctg aggctgcaga gggattcaaa tcccctggcc aggtgtggtg
80281   gctcacgcat gtaatcccag cactttggga ggatcacctg aggccaggag ttcaagacta
80341   tcctggccaa catggcaaaa cccatctct actaaaaata taaaaattat ccaggcatgg
80401   gggcggggcg cctataatcc cagctactct ggaggttaag gcaagagaat tgcttgaacc
80461   aaagaggcgg aggttgcagt gaactgagat tgtatcactg cactccagca tgggtgacaa
80521   agtgagactg tctcaaaaaa aaaaaagaaa aggcagatga ctccaaagac tctctcaggt
80581   gctccgggcc tggcacctgc tccccaatgc tctccacagg gctcacctgg cagaaggtgg
80641   ggctgtggac agctgacagc gcccggcaca gagcgtccac atcgttgaag ccaggtggca
80701   ggcggtccac acagaggcag cgggagtgga gaagggcagg cgtcagttgc ccggcatccg
80761   tccagtgcac gtagagggtg cgtggtccca gcggcttgcc cagcaggtcY gacttggcac
80821   gggcagccga gtccttcttc atgtactcag caaagccata gcccttggat tggccagtgc
80881   gctcactgta gaccaggaag cagcgctcca ggctgccgaa gggccgcacc agctcctcga
80941   actgctgctg tgtgaggctg gggggcaggt tggccacaca cagcagggca tccgtgggct
81001   gcagctgcac cgacagttcR cgctcccgca ggcggctctg gtggaaagca ttgattgcgg
81061   cctcggcctg ctccccattc agcagggtca cgaaggctgc ggtgggagga gggcagtgcg
81121   aggtcagccg ggccctgagg gcctgcccct ccacccccgc accctgcaaa ccaggtggga
81181   cctccaaatg ctgggcatct caggtgcctg ctgatctgag cagttgccag ccttggcgac
81241   tcacacaggc gagagcgcct gccattgact ctaggctcca cgaagcccac tccctctccc
81301   agccctgcgt ccacctgcac ccacagcagc gctcaccaac tgtgggcctg gctctgtcct
81361   aagaacgctg tgggtcactc gggtgatacc aagggcagtg gttaagccca tgctcactgg
81421   ggcccagatt taagccccaa gccccaggtg gctttggggg tatcagtttc ctcatctctc
81481   aaatggatat aacttaatca tcacaatcac cattttgcca gagaggaaac gggcccagag
81541   cagcacccct gtgccccgag taggggagcc tggacttgaa cccaggcagc cggactccag
81601   aggcccactc tacacactgc ccaccctgc cacctttcca ggccaccagt gcccctgaac
81661   cctgctgcca cgtgctgccc cagatttgcg atccacccag cggccgcagg aagctttgtt
81721   caaaacgatc acgccacatc catcttgtgg cttctagctg cagggtgcag tgcagcctgt
81781   gcggctcgc tgacctcccc tcccatctca ccgctgccac ccggaccacg ccaggcacac
81841   tccagagggg cctttgcagc tgctgtttct tgagcatgga acactgagcc ccacctcctc
81901   acctggttaa cctggaccca cccaggtaga aaccctgtct ctactaaaaa tacaaaaatt
81961   agccgggcat ggtggcacat gcctgtaatc ccagctactc ggaggctga agcaggggaa
82021   tgggctgaac ccaggaggcg gaggttgcag cgagccgagc tcgcgccact gcactccagc
82081   ctggcgacag agcaagactc catctcaaaa aaaaaaaaaa aagaccaca caagcagggg
82141   tgactggctg agtgaggcaa gagggggtaa gaagaagaa acccacggcc aaacgttgtc
82201   aagaattagc tcaatgccaa gcgagtggag taggaagaga atcagcccga tgcccagtgt
82261   tctccaagga gaacatgaag gctgtcccaa gatgacagga tgacaggcag attggggcaa
82321   cctgccatgt tggcctgggg ggcaatactg ggcctgaagc tcagagcagc agacagtgag
82381   ccaggccctc ccatcttcag ggatggtcac tccctgccct ggcccRcccc atggccccac
82441   aaacctgtcc ctttgtattt gtccacaaaa cagtatttga gctcatagtc actgagcagg
82501   tcatgtactt cctgtggaga tacaagacaa aagacaggga gttactggag atggaagggg
82561   gcaacccagt gccgcttcat agctgccacc agctatgaag gcaggtcaat taccacccc
82621   cattttacca atgaggaaac tgaggctcga tgcagtaatt ttgtcaaggt cattctgctc
82681   atacctggca gagatgggat tcagaaccta gctgcagact gtgctattac ccaggcaaca
82741   tgctcttaga gggtatacct ttagctggct gggcgggtg gcYcacgctt ataatcccag
82801   cattttggga ggccgaggcg ggtgaatcac ctgaggtcag gagttcgaga ccagcctggc
```

FIGURE 1-W

```
82861  caacatggtg aaaccttgtc tctactaaaa atacaaaaat tagccaggag tggtggcgca
82921  cacctgtaat cctagctact cgggaggctg aggtaggaga actgcttgca cccaggaggc
82981  agaggttgca gtgtgccact gcactccagc ctgggtgaca aagggagaca ctgtcaacaa
83041  caataacaac aaggccgggc gcggtggctc acgcctgtaa tcccagcact ttgggaggcc
83101  gaggcgggtg gatcacgagg tcaggagatc gagaccatcc tggctaacaa ggtgaaaccc
83161  cgtctctact aaaaatacaa aaaattagc cgggcgcggt ggcaggcgcc tgtattccca
83221  gctactcggg aggctgaggc aggagaatgg cgtgaacccg ggaagcagag cttgcagtga
83281  gccgagattg cgccactgca gtccgcagtc cagcctgggc gacagagcga gactccgtct
83341  caaaaaaaaa aaaaaaaaaa aaaaaaaata acaacaacaa aaaaaaaaaa aaaaaagag
83401  gccgggctca cgcctgtaat tccagcactt tggaggctga ggcaggcggg tcacaagatc
83461  aagagatcga gaccatcctg gccaggaagg tgaaacccca tctctactaa aaatacaaaa
83521  atcagctggc tgtggtggcg tgcacctgta gtcctagcta ctcgggagac tgaggcaaga
83581  caattgcttg aacccgaggg gtgaaggttg cagtgagcag acatcaagcc actgcactct
83641  agcctggcga cagagtgaga ctccgtctca aaaaaaaaaa aaaaaaaaaa aagagtatgc
83701  ctttagggaa gccatttaac ctgcatgaac ctcctttgc aagattcact gtttccaaca
83761  actctgtaag tgaagtatta acaaactcat gttgtatatg agaaaactta ggctaggaga
83821  agtgaagaga tctgctggag gccatgcagt tgggcagcgc agccacccat gggtacctga
83881  ctggggagcc caccttctag taagccccac gttgtgtggg ttcacatgcc tcccaatttc
83941  ctcctgctga taaagctgcc ctcttccaag ccagctcatt tattttttctt ttttttagag
84001  atagtgtctt gttctgtcac ctaggctaga gtgtagtagc acaatcatag ctcactgcag
84061  cctcaacctc ctaggctcaa gtgatcctcc cacctcagcc tcctgcgtag ctgggactac
84121  aggcacgcac caccatgcct ggctaatttt taaaaatttt ttgtagagat gagggtttca
84181  ctataccgcc caggctagtc tcgaacccct gggctcaata cagcctcttg cctcagcctc
84241  tcaaagtgct gggattaaag ggatgagcca ccatgcccag cctctcaagc cagctttgaa
84301  ggcaaagtgc tggcgcctgc tgggaccaga cacactgtgc atcttgcagg agagacaatg
84361  tgttcccagc tgagagactg cagacactga gaggaagacc cagaaagaaa cctgaccatc
84421  cttaatgatc cctgtcccga tctgtcccca aattcagccc ctcccaacat ccctggggtt
84481  ccactagcca cgtgcccacc cggtgtgctg gtgggccgga gagcagggaa tctcagcagc
84541  aggaagcgag aacctatttc accgccatag ggcagggcag tatagatgcc atttccctgg
84601  gtccaaagag cattgggaag cgctgcccca tgctggcccc atgagaaggg cactcctagc
84661  aggaagatta gccacgaggg gctccataga acacaggcct cgcttccttc ctgtaggtct
84721  gtaggctggt ggcagaagac cccattttcc caaattaatc ctgaggtttt ggggggctgag
84781  acccagggc tgctgttaac ttccggattt atctctgaga gcagtgaata aacgcgtgat
84841  atggagggc gtactctccg cagtcctgaa acttctggat gtgaggtccc gccaccctgt
84901  ggtagagtgg gtggagaaaa gcatcatcca agcaggggc aactggtggt ccaatgtacc
84961  agcccattca caattcccca acaggaccaa agctgtccgc ccccttccat tccccgcccg
85021  cttccatcac ttggtgtcgc ccaagcctgt ggtcgcccct agcaacgccc tccctcactt
85081  cgcagtcggt ttccccttc atcatcgccc ccccacgtcc cgctcttggt ctctcccgat
85141  cccgcgtgga tccggtgctt gggcgccccc gccaacgacc cccgcgcacc tcagcgttgg
85201  tgtcgcccgg ttcccccgc gcacgcgcac cgtggtattt cccgccacgc tcctacaccg
85261  cccccccaa tacctggttg gtcacgtccc ccgggaggcc ccggatcagt atcttgcggc
85321  ggttacgaaa ctggcgctcg gtgtgttcca ggcgtttccg gatctcttct ggatctagag
85381  gcggcagctc ttcttccggc gcccggcgct ccgcggcatc gccggcttcg acttcggccc
85441  cagacttagg gctcagcggg ggccggtgag taacggacac gtccgccgcc atcttgggaa
85501  acccggcgcc ttctgggacc agcgagccgg ggcggacgg catagagcgg caacgagggc
85561  gcgcccgtcg attggctggg agaaaccca cctccttccc gccccccttg ccccgttggc
85621  taagccccag cccaccctc aagagttcaa gctgcgtctg cgcgccacag gccccgcccc
85681  cttccgtcgc agcgacgcta ctcagtggat gtgcacctgg gtgggagaga cttgcagcgc
85741  gggtggaatc aaaccacaga ttagggagtt tgaaggcttt attggtgcgg aatctgaggg
85801  cacagccaag cccccgccaa ctttgatccc ggatcccagc gtcactcagc tctggacggt
85861  tcttcccccca ttgcttctgt cggctgcata gacgtgaggg gcagataggt gStctcctcc
85921  ctaacatggt aactgccgct ccgttggtgc tccctgaaga cgtacattaa ggccagtacg
85981  atagtcacca cgcccagggt cagtaacacc gccacgaaga cggggacaaa gtgggagctc
86041  ccagctgtgc agagaaagcg ctaagtcaat atgcgtccct tctgtctcca accccccgc
86101  ccccggctt accggtccag acccgcagcc ccgtRttagc tcaccctcaa tgtccatcac
86161  cacgaccagg gtgtatttgc ctcgtgagct ggacgcttgg cactgataag taccattatg
86221  tgttacgttg acgaagaacg ggatccccac cggcacctcc cggctggagc cttccttcaa
86281  acaccgcagc tcggggtacg ggttgcccct gcttggcac tgcaggacgt gtctcgtttt
86341  atctttccat ttcaagtgct gggggcatgt ggctcggtca attttgggac catctgtgga
86401  accaccatgt gtgatcagac acccaacaca cccgaggcac agtggtgcag aggagcgtct
86461  aatcttccca gggcagggt ggagggatta aggtcaggg tgaccgactc acacaggact
86521  cgcagctgga cgctactgtt cctgtgcaag aactcgccgt ccacctcgag agtggcactg
86581  cagaagaagc tgcgtccgtc gtcactctcg gtagcattta gctgaagttg agctggctgc
```

FIGURE 1-X

```
86641   cccggggccg cggccggaac tccgtccagc gtgacctgga ctcgagcccc agccatgcaa
86701   ctcacggtca ctgtggaccc ctcatgggcg gtgggctcgc tgaggttcac aatgggtcct
86761   aggaagccta aaggcgggc attgcccagg agcttaatga acaggacctt cctgtgggtc
86821   aagccgctcc ctccgccctc cccttcctc tcgggatatc cgggccacgc tttcggccgt
86881   tcaagcctcg ccctcttcc gcgctgtgtc cagcttcggg cactcaggcc caacccacgt
86941   tgcaactgct attggggcaa gccaggcccc accttttcgg ctagtctccg cccctctgc
87001   cacgcccca gactgctgag gccgcgcccc cttcccacgc ctcctcttac taaagaccgt
87061   caagttctcc cgggcctccc gtctctcgcc ccctagggtc acgttgcaga cgatctcccg
87121   ggcaccctcc tgatccgcgc gcgccgtggc tgtggctgtg gccgttagcg tgtccccgtg
87181   gttcatgact gtcgcattca gcatctggtc cccagcgcc aggtagacct gggcctctga
87241   ggctggaaaa agcccgtcta gggtgcagtc caccggccac gacgtttcca cctccaagaa
87301   ccgggggcc acgaggcgcg gggggtcac gggcaggact ggggagaaag gtgggcatag
87361   tacaaccccc aggactgtgc cttccccagg acaccctcat ccccccagt caggatatct
87421   tgctgactgg gtcacccttc ttcacaggac acacacag gccatgaaa acggccttct
87481   tcaaagatcc cacggctcgg gcctccttc cggggccacc ttgcccagtg gccgggggct
87541   ttccttccca gaagcctgtg aggtccgggg tacccactc tcaggaaccc caaggtcagg
87601   gcaccgtcta ccctggctca gctcgtcacc caccgtctga agccccttct ctcaccaaag
87661   gttcggagct ggcggggggc tgaggtgttc acgaacagtc ccagccctg gggctgcatg
87721   tccagttctg tgcggcatga gaaaggggct ccgtggtcgt ctctgctggc cagcacagtg
87781   gcagtgacct ccgctggctc ctccactgcg ggctgccggc tcagctcctc ctcccagcga
87841   agcagcacca ccgtgaggct ggtccggggc gacccaYcct ccacttggca gcgcagggtg
87901   aagttctggc ccaccggctg ccaaggaggc aggggtgcca gctccacacg ctccgggagc
87961   cctgagagag gaggggagga tggcacttag cgggtcctgc aaacccaccc actcacccca
88021   gggactgggg aggagacagg gtRgtcctgc cgagaactgt gagctttgag ttaataaact
88081   tagagggctt agagctgggc cagtcgaagc gtttgctatt atcattagcg cagtgattat
88141   catttcctgt gttgtcagat accttgcaag gcgctaaaca aaactttctg ttctcaaaga
88201   tggcaMaata aaaaaaaatg aggatggaag ggatgaacgt ttatgactat gatatgaata
88261   ttaaaaattc ctgtttatgg ccagacgtgg tggctcacgc ctgtaatccc agagctttgg
88321   gaggccgggg tgggtggatc aaRaggtcag gattattcag ttctctccaa tcaggttcag
88381   acactcaggg ctttcctggt tcaccagccc tgtggcagcc tctcaagata ctccggcaca
88441   gtcacaggag acttgacact cccaggctgg gtgccctccc cagtacacct acaaaacgct
88501   gggcctcagg ccgggcactg tggctcactgc ctgtaatccc agcactttgg gaggccaagg
88561   tggacggatc acctgagacc aggagttcaa gaccagcctt gccaacatgg tgaaacccca
88621   tctctactaa aaatacaaaa attagccagg catggtagca cgtgcctgta atcccagcta
88681   ctcaggaggc tgaggcacaa gaatcgcttg aacccaggag gcaaaatttg cagtgagctg
88741   agatagtgcc actgcactcc agcctggcga cagagagaga ctctatgtca aaaaaaaaaa
88801   aaaaaaaaa aaggctgggc aaggtgactc atgcctgtaa tcccaccact tgggaggcc
88861   gagggaggcg gatcacttga ggtcaggagt ttgagaccaa cctggcccat atggcaaaac
88921   cctgtctcta ctaaaaatac aaaaattagc cgggcatggt gtcacacgcc tgtaatccca
88981   gctactaagg aggctaagac aggagaatca cttgaaccca ggaggcggag gttgcaatga
89041   gctgacatcg cgccattgta ctccagcatg gggacaata gcaagactgc gtctcaaaga
89101   aaagaaaagt caaaaagtag gccaggcatg gtggctcacg cttataatcc cagcactttg
89161   ggaggccaag gcgggcagat catttgaggc caggagtttg agaccagcct gggcaacatg
89221   gtgaaatcct gtccctacta aaaatacaaa aattagctgg gcgtgttggc atgcgcctgt
89281   aatcccagct actcaggagg ctgaggcagg agaatcgctt gaacccggaa ggcagaggtt
89341   gcagtgagcc aagattgcgc cactgcactc tagcctgggt gacagagtga gactctgtct
89401   caaaaaaaaa aaaaagaaa agaaaagaaa aaaaagta gccaggcctg caatcccagc
89461   tactggagag actgaagtgg gaggattgcc tgagcccagg agtttgagac caacctaggc
89521   aacatgggaa gatcctgtct ctaaaataaa ggtataaaaa agtgtaaatg taaaacctcc
89581   atttgcctac tgctgactga aaggggtacc ccctttttg cttaagagac aagggtcttg
89641   cttttttgca caggctggag tgcagtggtg caattatagc tcactacagc cttgaactcc
89701   tgggctcaag cgattctccc accttggtcc cccaagtagc tgggacttca ggcatgtgcc
89761   accatgccca gctaatattt tttatttatt tttgtagaga cggggtgtcc ctatattgct
89821   ctgcctggtc ttaaatttcc ggactcaagc aatcctcctg ccttggcctc ccaaagtgtt
89881   gggattattg ttggggccag gcgcagtggc tcacacttgt aatcccagca cttttgagagg
89941   ctgatgtggg cggaacaccc cgtctctact aaaaatacaa aacttagctg gcattagct
90001   ggacctggga ggcagaggtc gcagtgagcc gagattgcac cactgcactc cagcctgggc
90061   tacagagtaa gagacgccat ctcaaaaaaa aaaaaagct tgttggggcc gggcgcagtg
90121   gcccatgcct gtaatcccag cactttggga ggctgaggtg gcggatcgc tgaggtcag
90181   gagttcaaga ccagactggc caacatggtg aaatgccatc tcaactaaaa atacaaaatt
90241   tgctgggtgt ggtggcgtgc atgtgtaatc tcagccactc ggagggctga ggcaggagaa
90301   tcacttgaac ccaggaggcg aaggttgcag tgagccgaca tcgtgccact gcactccagc
90361   ctaggcaaaa agagcgaaac tctgtctcaa aaaaaaaaa aaatgcttg ttggggccca
```

FIGURE 1-Y

```
90421  agttaattga tttcacaact gctgccttgg catgagattg agatgcgtct ctatatctct
90481  gtctctgtct ctgtgtctct gtctctgtct atctttgtat ctcacacaca aatgtccagg
90541  tctgagctct gggtcagaac tgtggtccat tctttgcaaa ctgagggtcc ccactctcct
90601  gagccattgg ccacttgccc acaccactac ccaagaccag tcccacctcc ggacacgtcg
90661  actcactgta cacggtgatg ttagaggagc ctgttatctg Rgagccattg cagtacactg
90721  agcagaggat ccgactgttg ccagtcacgt tgctgagatt gaaggctgcc cagcccatgc
90781  cactggccac cagctccttt gatagggacg tctccaaggc gattttctca gagctgggac
90841  aatcagtact gcagttcaca aacagggacc ctccagcaga gagcacaggg ttctggggct
90901  ccacccgcaa aaggaactcc tgcccctgga caccttcagg aacatgaaga gtcctggtg
90961  tttgtttcct tgtYccccaa cccacgcatc aacaggcccc accatttaac acctctctcc
91021  ttgtgccgag acagaagggt tcctgccttc atggtccagK gggaaaggta gaatccatca
91081  gagaccRggg agaactcaga aggaggccag aagaggctct gatccagcat aggaggaggt
91141  gagtcaggga aggcttcctg gaagcgggga ccattgcagc ccgaaactga aggctaagta
91201  ggagttagca agtgaaaggg acaggtgatc ctggcagagg gaagcacata cgcaaagggc
91261  aaatttcagg agttcagatg gagcaggaag catgagggt gtgtgtgtgt gtgttagggg
91321  agagggatgg cgtacaagcc tatgctgggg cctgaccacc tgaaggctga actaaggaac
91381  cagaactttc tcccgaggat acagagtcag cggccaggtc gcagtgtggc aggatgtgaa
91441  cagcgttgcg ttctattcct ctaccctcta ctgatcccca aaacgcagcc ctctccagcc
91501  ctccccggct tgactggtct cacctggggt cagcagacag cagaccagca gagtccagca
91561  ggccctgggc cacaacacgg atggtaccat ggtRgccatt ctgacagagg aaggtgcctt
91621  cctgaggtgc ccgaagggca ggcagggaa aaggcggggc ctcccactgc gacggaagca
91681  cagcggttaa gattgcagaa gtctggggac tgcaccttgc ccaggcctgt gggtggaagg
91741  ggatgctgtg gcccttgggg gccagggtgg gggacccaga cggggctctg caaagtggcc
91801  agcactgctg agtctccccc agggaatggg ctggtcccag ttgcactgct ggccccatt
91861  tgaattcaca ggaaatgcta actaaactgg tttcttttgt tctcagcact gggaagcctg
91921  ggtgggggg atgaggcatc tccttctggc tgaacttagg tgggtagggg aatattctgt
91981  ccccagagag gaagttaatg gggaaaactg taggcaccat tgtgtagatg ttaaggtggg
92041  atttcgagga aacattaaaa aacaaaaaca aaaacagaaa cagaagcaga gtcttgctat
92101  gttgccccga ctggtcttga actcctggcc ttaagatggc ctcctctcat cttgacctcc
92161  caaagtgttg cgattacagg cgtgagccac cacgcctggc cacctttgaa gatcttgagg
92221  atacctccct atctttgaag atcttgggga tcccccatcc cctgcacaaa gagctaaggt
92281  aggtgatttg gggacagctg aKtccctgag ccactgtcta tccaggattc tacttggttt
92341  ttgtttgttt gttttgagac agagtctcac tctgtcaccc aggYtggagt gcagtggcgg
92401  gatctcggct cactgcagcc tctgcctccc gggttcaaac gattttcctg cctcagcctc
92461  ccgagtagct gggattacag gcatgtgcca ccacgcccgg
```

1    tagacagtca tatataatgg aaactgcaaa cctccgaaag tgtgtctgcg tgtgggcaaa
  61    tagtaaaata gcattgaata cacaatgtct tcaaacacag tacacaagtt tgacagttat
 121    tctaactgct ctaaaattct ttttatcaga ttcactgcta acatgcatgg aaaatatgat
 181    gacaaattcg Ragattccta aaagagaaaa gaaggctata taatacaatc aattattaca
 241    ttgtcttttt tcacaattct gtaataattg atggtaattc aatagatatt tatctttatc
 301    taacttatc tttaaaacta tcccaagttt acttattact gctacggttt taaattgcag
 361    cagctgaaat atagtaggac aaatgcataa tttggaataa gactaaatat tgcatttcac
 421    cttgatcaca tcgtctctgt gccctgagca aatagtttaa cttctctaac cctcaatttt
 481    ctcatctgaa aaaaaaatg aatcctctct ttcggacttt caagaaattt aatttggaag
 541    atataaggga aacatttgca tctactacag tgtttctcaa agtgtaatgc acccaggaat
 601    cacctgggga ttctgattca gaagctctgc attgggtgct aaaattttca gcttccaggt
 661    gatgccagtg ctactattct attattgctg atgttatctg gaagctggtt tataatgcaa
 721    aatctcatgt cccacccaat gcctactgaa tttcaatctt ccttttaaca ggatctccag
 781    gtaatttta tgaactttaa aatttgaata acattgatgt agcagtagat cttgcttatt
 841    gctgatatgc agtcgaaaat attataagtt ttgaatcatc acaagaaaag tgtgtagaat
 901    ataaatgaat ataatatgtt ttttcctctt caaaatctga ttttgaatta tatttcccag
 961    gtgtcaccgg aagctaaaga gtggccttgc ctcaggtcag gtttctactc cctgacagcc
1021    tctcaattag ctgctgttgt aatgaaatta tgcattgtca aaagcctttt tgcatcattt
1081    tcttcaccaa atctcaagtt ttaagtattt tatatagaaa ctacataaaa tccaacctg
1141    ctctgcccat tccagtggct gccagatagc tggttttctt tgtgattttg ggctgttggt
1201    tttctaggag aggaggagaa gattagagca agttaaaacg ccacagacct tgctgctctt
1261    actgagattc agccattttt cttaagtaaa cactctccag attgcatcaa gccattagtt
1321    aatttacaga attccaaaat agttgattct ggagattttt gctagttgct tatatggtga
1381    agaggatttt tggaggtctt cactacacca ttctggctga tgtcgcttaa aatgccctga
1441    agttttgaa tggtgaacaa aagtcttatg gattttcatt atcttgataY attagagaaa
1501    ccatgcatcc acctgattgt attgggctcc atttacagat gccactaaaa tatcttgata
1561    gtttgaggca attattagat gagaggtcac agtgacctcc tcctaagaaa tatttctcag
1621    aattaaatgt caaatttta ataaacattg tattatgatt aagagcccag gttttaatg
1681    aaccctggga tcaagccctg ggtctggtcc ttaacgtgta accttaatca agttacttaa
1741    cctttataat acagtgataa taacagtatg tatgtataga tttatttcaa aattcaatta
1801    aattacaaaa gcaaagtgct tgacacagtt catggcacaa agtaaatgct caagatgttt
1861    tagcttctat tgctattatc atagttaaga atatggtttg gtactgataa taatgaa
1921    tgttctcttg aatgtgtttc tttaagagtc acattgaaat agaaataaat aaaaactgtc
1981    tcactcatgc tactttatgt tctatgcaat tctaggcact gtggtggtcc agcagttgat
2041    gtcagtgatg attagcaaac atgattgcct cttccccaaa gatgcagaac tacaaagcaa
2101    gccccaagat ggagtgagca acaacaatga aattcagaag aaagccacca tggggcagtt
2161    acagaacaag gagaacaata acaccaagga cagccctagt aggcagtgct cctgggacaa
2221    gtctgagtca ccccagagaa gcagcatgaa caatggatcc cccacagctc tatcaggcag
2281    caaaaccaac agcccaaaga acagtgttca caagctagat gtgtctagaa gccccctct
2341    catggtcaaa aagaacccag ccttaataa gggtagtggg atagttacca atgggtcctt
2401    cagcagcagt aatgcagaag gtcttgagaa aacccaaacc acccccaatg ggagcctaca
2461    ggccagaagg agctcttcac tgaaggtatc tggtaccaaa atgggcacgc acagtgtaca
2521    gaatggaacg gtgcgcatgg gcattttgaa cagcgacaca ctcggggaacc ccacaaatgt
2581    tcgaaacatg agctggctgc caaatggcta tgtgaccctg agggataaca agcagaaaga
2641    acaagctgga gagttaggcc agcacaacag actgtccacc tatgataatg tccatcaaca
2701    gttctccatg atgaaccttg atgacaagca gagcattgac agtgctacct ggtccacttc
2761    ctcctgtgaa atctccctcc ctgagaactc caactcctgt cgctcttcta ccacccctg
2821    cccagagcaa gacttttttg gggggaactt tgaggaccct gttttggatg ggcccccgca
2881    ggacgacctt tcccacccca gggactatga aagcaaagt gaccacagga gtgtgggagg
2941    tcgaagtagt cgtgccacca gtagcagtga acagtgag acatttgtgg gcaacagcag
3001    cagcaaccac agtgcactgc acagtttagt ttccagcctg aaacagaaa tgaccaaaca
3061    gaagatagag tatgagtcca ggataaaag gtaaggaaaa tctggaggtc gtaactacca
3121    gagagggctc agtagcctcc tactgtggga caggatcaca ctgagggtga catatgctgg
3181    ctccaaagtc aaagaaacac aagtttgctc catcatttat gagctttgtg actgtgtgca
3241    agttagcttc atctctgtga gctttgattc cctaatgtaa acaatttaaa tactagtagt
3301    atctacctca aaagcacata agaagtgatt gaacatttcc ctggtacaga ataggctcaa
3361    taatgtcatc tttgattatt attaaataga tagatttgca ttagagggct ggaaggagag
3421    gggctgtgag gagatggaca gagcattagg agcctgttag ttttcactaa caagaaaagg
3481    atgaaactag ggtaaaaaaa gtagaagtaa atagacctcc atgtttatt cttcaatca
3541    ttgaatgttg agagagtgcc ttctatctgc caggctctgt tccagacgct gaggattcag
```

FIGURE 2-B

```
3601    atgagctgag agaggccata agagccaggt gacataggg attgacaggc tgattttcag
3661    cctttgactt ttactctgag atagaaatcc atggaggttt ttgagaagag gggtgacgtg
3721    aagtatgttc acatgaataa ggaagactgt agcctaaatg aggaaaaaag aatatgattt
3781    Rtaaagaagc aattatgcta aaacctaatt atatcaatgt gcatcttctc ataaaatgat
3841    caaagtagga gtagctcctc tagtgttctc agtcccagtt tcaggctgtg tgatttggac
3901    aacccttcct ccatggtgtg ctaggatcct cagtYggttg ttaagttggc tttaatttac
3961    cttaatatgt ttcctatcca ttcatcaatt atcagacaaa aagataacgt actttcagaa
4021    gctatggcaa aataaatatt aaaaaatact acttataaat gagattgaaa aattacttcc
4081    ttggaaagta ttttttggt aagtttcact gagtggaatt gtggtttgaa tttttctata
4141    taatggagag tgacaggaga tttaagaaa aatatagggt cattatctta aaaggttact
4201    cttctttctg aatgtagttt ttggaaccac tatgtattgg aattctgaat tactgccaat
4261    ccatgatgat aaattagcat ttcacactgg gaagcttata ttttgaggca aggggtcaca
4321    ctttaaatgt agtagaaaaa gaaaaaagtt atcactatga atttgcagat ggatacattc
4381    atttctgagg atgttgctga tgcatatatg ttctgagatc tacggtatat ttcagagatt
4441    ttgataaact gatagaactt cccaatagag gtcatcttaa tgggccattt cagtgtcaca
4501    ttcttaccct cRtgacaggc caagggagag ctctgcagta gggtggaggg tggggaccg
4561    ctcgtggcct agccatgaaa ttatagaaag ttaactgttc tggctaaatt ttgatcattt
4621    ctgtttagag ttattcattt ttctttaaat tcctttataa ctttacccca caagcattga
4681    aggtagatgg atggatagat aggtaggtag gtaaataggt aggtaggtag gtaggtagat
4741    gatagataga tagatagatg atagatagat agatagagag atagataata gatagatgat
4801    agatatagat agatagatag atagatagat agatagatag atagatagat ataataa ttttactttg
4861    tttaattatc aataagatat atgtttaaat catttataac tttaccccac aagtattgag
4921    ggtggatgga tggataggta ggtaggtaaa taggtaggga ggtaggtaga cagatagata
4981    atattttact ttaattatca gtcagtgaga tatatggttt ttagttttga aacatatatt
5041    cttttccct ctccaaattg gtttctaact ttttcttttc ttattttttt ttatgtttta
5101    ttttttgaca gagtctcact ctgttgccca cgctggagag tgcagtgatg caatcttggc
5161    tcactgcaac ctctgcctcc caagttgaag cgattctcct gcctcagcct cctgagtagc
5221    ttggattaca gatgcatgcc atcatgactg gataatttt tttttcttg tggagacagg
5281    ggttttacca tgttggccag gcagctcttg agctcttgac ctcaaatgat ccacccacct
5341    cggcctccca aagtgctggg gttacaggca taagccatgg cactcagcta gtttctaaca
5401    attttcttag gaaatattgt attgtggtca gagaagttca tctggatgat attaattatt
5461    tggtctatta aaactattcc cttattactg gattgggatt ctatatatga ccaagagatc
5521    aagtctgtta atcaggctat tcaaagcttc tgtatttctt ctcattttta tcagctatat
5581    caataatttt tgagaaagat actttaaaat ttcctatcag tattctgagt ttatcagttt
5641    cttttttataa ttttgtcata ttttatattg aacaattgga ggctctacta ctaggtgaat
5701    agaagtttgg agttgttcat atctccctga agaattgatc ctttttatcat taattagtgc
5761    ctatttttca ttgtaataat gcttttacc tgaaactcta tttttctga tattaatatt
5821    gtcctaccat cttcctttga ttagtaactt cctgatatgt cttttccttt atttaacttt
5881    caaactttgt ttgatgattt gatctaacaa cttacatctt tacaattctg gaatattttt
5941    ttcatcatct ttttgtctat ttcatcttcc caccttctca attttctctt tccagaaccc
6001    ttattaagct atgtttgacc ttgttaatct atcctctgtc tttgttaact tctttttttcc
6061    atattaaatt tctataatta tcattttga ggcattctag gtaactttc tcagacctgt
6121    tttgtagctt actaatactc tgatgagcta attcaattct gatacttccc caggcccatg
6181    attggagatt ttgtagtctc ttcttcataa aaacagttaa tgttccaagc tctcagttaa
6241    attacttgta gttttctgcc tgcctaatac tggaggcctc accttctgtc cccatgtgaa
6301    aaagaaaaac ctagacccaa gctctgtggc ctctatccaa gactaatatc cttcgtgtgc
6361    ttctacttat tgttctatat ttcggtttct tccttggttc tgatggctga agctgctgtt
6421    ttatttttaac cttgatgatg tattttaaaa atatatttct taaaacttt ccagcactt
6481    tatatgtttg cattgggagg gatttcttct gtattcaact tagtcctttt cattcctgga
6541    agtttcccac aagcacctga tacatacaaa tgtgtcaata tattgttttg taagggttgt
6601    ccttctcagt attttaattt caatttcttc caaattttg gctctaaaat agcttggaa
6661    aacaaagaga atatattgta gaataattct gagtggaaac cagcatagta ccaacttttc
6721    atgtaaaaat gtggtcatat gtttaaaata gccttctaaa tgatgtagga ttacaaaata
6781    tgaagtatta ttttttaaaa ttctagttgc ttacaaagag aaggaagatt aatttttaag
6841    tgttcttatt atctggatga aatatcaaca tgtggggatc aaattttca aagcagaaac
6901    ataattgaga ttttaattta aaactgtta ttaaaataat cagatatctg agagctacac
6961    atgcattaac ctttcaaatt tcagtggtat ggtaagtttg aatgagtccc atgggacttt
7021    tgctcagaat aggagaaatt aaaaagtcag ccgaggccaa gatacatctt aaataaagat
7081    gtaactttaa tacccctctt tgaataata tatgtatatg atttggatct tagtggttat
7141    ggagaaaaca gtctctgttt ttaaaaacgt tactgcgaat tctacaatta tccaaaagct
7201    atacaaaaca actatccatt tatagagata taaaataacct atgcccagag ctatattaat
7261    aacttgggaa gcagtgagaa ttggggatgg aaaggaatgg gctttatttt tacaaaatat
7321    gagatgcagt gcttatttaa cacatgtgat ctttacctc cgtatcaatg taagctcatt
```

FIGURE 2-C

```
 7381   actttgggta ctctttata  agatgggact ctatatgctg ccaaaaaccc cattcttagc
 7441   agtgaactta accaacaatg acatttcct  atcactattt ttcctttat  agaaggcaaa
 7501   tgttattgcc ctctttttt  tttttttttg ttaactatca gactttcctg ctgcatttag
 7561   tgtagtgaac ttYacaattt aatgtccagg aagctttctg cctcgtctgc ccggcatgtg
 7621   ttactggctt atctgtgctg gcattcactt atttactatt aaatgacagc tgcttccaag
 7681   agaggccttg ggacctaatg actaaggtga cagtaaatca tcttagcaaa cagtaaaata
 7741   atacaacaaa attacatcct ttaaatcatt gaaagggctt tattccaatt tcctaagcat
 7801   cataaagagt ttagaaaata tttgtatgtc tcttgcattt caagtgaata aaatcacttt
 7861   atctcttact cttgcgtccc cacccccac  ccccccaac  atcctttgta gcttagaaca
 7921   gcgaaacttg actttggaaa cagaaatgat gagcctccat gatgaactgg atcaggagag
 7981   gaaaaagttc acaatgatag aaataaaaat gcgaaatgcc gagcgagcaa aagaagatgc
 8041   cgagaaaaga aatgacatgc tacagaaaga aatggagcag ttttttttcca cgtttggaga
 8101   actgacagtg gaacccagga gaaccgagag aggaaacaca atatggattc agtgagcctg
 8161   ctttcgcctg ctgtctctga tggctctggc aaggactcca gggattctgg tgggatatga
 8221   cttagaacca ggtggctggt cacctggatg tacagaagtc taactggtga aggaatatca
 8281   tttacagaca ttaaacatcc atatctgcaa tgtgtaccaa agttatatca tgccccataa
 8341   tgctactgtc aagtgttaca actggatatg tgtatataga gtagtttttc aaaagtaaac
 8401   taaaaatgag aagcatattt caagaattat tttattgcaa gtcttgtatt taaatgttaa
 8461   atcaatWtgt tgttgcaatt tagcttgctt tcaagcttca cccttgcac  ttaacataag
 8521   ctattttgg  cattgtgtta tcatcggctt attttataga tcaatatttt tatttcccctt
 8581   ttttgctgag gaaatgaaga taagcaaaaa tataaatata tatataaata tatgagttat
 8641   taaaatcaga agaatacttt gtggctgtgc tgtttgtgcc aatagacttt gtcatgacca
 8701   aaaagagaaa tgtaaatagt tttataaaat acagtcgaat caccaggaac ctttgagctg
 8761   cttttaaaat tcttcccctg gcaccactca gttttgcttt tgcgaggcga tttgacatag
 8821   gaactttgag actccatgag aaagtccctt tctgaggccc actgtctacc ttgccagatc
 8881   ctcagtgcgt atcgccaatg caggatgctc cttagaaaag aaaaaatggt aaagaatggc
 8941   atttaacgat tcaggctttg aattactctg tccctctgga ccgaatctct ttaactgctg
 9001   Satagtttta gaggaattct cctgctactt aggtactggg aaacaatgct tgctaaacca
 9061   tgcccacgtg agcacctgtc tcccactcaa acctctccca tctcccaaca actgcacttt
 9121   agaataccag cagtgaaatg gtattactgt ttccctctga gtgaaactgc tagagtatat
 9181   gtcacgtagt gacattttt  tctcactcag gctattgcca tctgggattc tctccctact
 9241   acagctggca aagttggttt gcagcaagaa gatagtggga ggggccagg  ctgcaggaga
 9301   aggagaaaag tttgaagaa  acaaaccatt ttgcttctaa ttttgacagt atcactttcc
 9361   tgttaaaaca tacaataatt ttaaaaggtg aatgcctaaa gttccaattt tagcaaatat
 9421   gggaacctca gcaatgctaa ttttctagaa aaacccaggg ctctttggag ctagagtttt
 9481   gggagaacag ttcttcacaa taaggcaatg gttttgagag gccaggcaaa taatctttct
 9541   caccgtagaa caaaaagtta caaaaggcat aatcggaaat agagactaca tacttgagtt
 9601   tatggggttt gtgttgtttg aaggttcaat gcttgcatgt gtttatttat tttcaagagg
 9661   gaaagtggtc tgtactgctt tcatccttgc cactgtcttg cttttatttt ttactctccc
 9721   actgagcaag cRtctgtggt cctatggtat caaccagtat ctttatagca ataatttctt
 9781   taattcccctt ttctctctct ttccaattat ttaaccagtt acttccacct ggacatacga
 9841   taggaaattc aaactcaaaa tatgaaaatt gatcttaata actctcccct tcatatctttt
 9901   cacctatttc cagtccttat catagttgat aaaaacctca gactcatcca gaaagctata
 9961   tgatgcacta gtaaaaaaaa caaagatatt caaactgctt gggttcaaat ggtatacaat
10021   ttgccagctg ttactgaacc ttctatgcat aactttttt  ttcctctgtg caattggaat
10081   aataaaaata ctactcccat agagttgtta tgtggtctta atgagatagc ttgggttagg
10141   ctgagcacag ctgctagtag aatccaaaaa ggggccaggc atggtcgctc acgcctgtaa
10201   tcccagcact tgggaggcc  gaggcgggcg gatcacgagg tcaggagact cagaccatcc
10261   tggctaacac agtgaaaccc tgtctctact aaaaaaaat  atatatatat atatatacaa
10321   aaaattagcc gggtgtggtg gtgggcgcct gtagtcccag ctactcggga ggctgaggca
10381   ggagaatggc gtgaacccgg gaggcagagt tgcagtgag  ccaagatcaa gccactgcac
10441   tccagcagcc tgggcgacag agcgagactc cgtctaaaaa aaaaaaaaaa aaaaaaaaa
10501   gactccataa atgttaacgc atatttctt  tctttcttc  tttctttttt tttgtggggg
10561   gacagtctca ctgtctcctt ctgtcaccca gtctggagtg cagtggcatg atcacggttc
10621   actgcagcct tgacctccct aggttcaggt gatcctccca cctcagcctc ccgagtagct
10681   gggactgcag gcatacgcca ccatgcccag ctaattttg  tattttcttt tgtagagaca
10741   gggtttcgcc atattgccca ggctggtctc aaacacctgg gctgaagctg tctgccctcc
10801   tcagcctccc aaaagttatg caagatgcat agcaatgacg ggtcacttaa tttgtctggg
10861   actacaagcg tgagccaccg cgcccagcca actcatattt ttcttctcta cccacttctt
10921   cactcataaa tttgctcacc agctaatcta ttccactcat ctttgccttt taatctgct
10981   ctctttaatc acttttccct tacctttttga tgaaggcatc ctaccagcg  cgttttgttc
11041   cagcatctct cctgtacttt tgtccttttgc aggctgcctt ttcgaaatta ttcatctgac
11101   catagcttga tcttgctcat tacatatgat gactgtcact tgcccaggac aaagcccttc
```

FIGURE 2-D

```
11161    acatagtgta aaaggtccta ctgccagttt cattcttgtc tcctaccact tcccaccaca
11221    cctgccatgc catttcatac ctctagaact ttccacttgc tattgttgtg tccttcttgc
11281    ttgccttctt tctagctggc atgctccaaa catcctttaa gagccaaatc aatgtcagtt
11341    tcctcatgaa gcttcccaga atctcaaatc agtgttagtt gcttttgtg cccccattcg
11401    cattatctct ttctgtcttt cccacatctg attattttct ttatcaaata agaagcaatt
11461    taggagggag agtgatgaag tggaaatagc agaaaattga gagccattca aacctagatc
11521    tgcctctcaa catgccttat gcaagataca tggcaatgcc aggtaacttg acttgtctga
11581    tctcatctac aaggtggaga taataactcc tacaaagtag ggatgttgcc gtggttaatg
11641    gtggtatgta atgtgcttat cccggtgcct gtcactttgc tccactgata actctattga
11701    taaatggagc ttcttaaggg gccaagattg tatcttcttg ctgttaaatc cctccatgcc
11761    ttatgccaaa gagaatgtca gcacagtgag tttgcagtaa ttttgggaa tgcaaatata
11821    ctcaaacaca cacacacaca cagggtgttt tgtggcctgt gatatttgag ggatgatatt
11881    atcaatttta attgtcaatt tcagtgatga tggcactaat caatggatac catgagcagc
11941    atgttcatct gggtttccgt tagtcaaata aaagcctag acaatattaa gtacaattaa
12001    cataagaata aattggaaat caataaggat acaaagtagt taggtagtat caagatttca
12061    tttgctacat cctgtatatg cctctttaaa actatttagg taattaaaat gaatcttaag
12121    ttataaactc gagaaaggat ttgcttttcag atgtggggcc tactgtgtta gcctcactat
12181    tcaaactaga tgtctgggta tcctttggag aacatttaag gtagaattgc ctatgatgtc
12241    agctctactg aaacatgatt ttattatatg taacattatg aaatgactaa aatctccagg
12301    tggagtttaa gtaatcattc ccattgattc tcaagctggg atattcttca aaaatcatt
12361    cccaggctgg gtagtttata ttattgatat aatttatgaca ccttgaaaat tcaggagagc
12421    attaaataat gtaatgcttg ccgcaaaccc cagtgttcct tacactgcag agctgcactc
12481    tgattagagt accatacgca tgagttttgg aatctacgac cagggttcaa acccagctct
12541    gccacctcat agctttatga acctaaatta tgtaatatat ataagcctaa atttgttttt
12601    ttctggaagt agagttaata gttcctccct tatcatcttt ttatgaggaa tgtagtacaa
12661    taggtgaagg gattaacata gtgcctggaa catagtaagt gctcactaaa tggaaactat
12721    cagccctcaa attatttctg ttgaaagagt gtttcagctt ctaaggaacg tagcaaggtt
12781    ctggactcag ggatatgacc agcattaaaa gtatcatgat caccagcaca ggatataatt
12841    atatcttggt ctcagagact cttaagttta tccgtgccca gataatcgc cagggattga
12901    tggcaaggaa agtaacccaa accactcttt cttctgaga taatacaatt acatccatga
12961    tctgaaaatc atgtctaaac aactacgtgt aactgtcctt catcaactct atccatgtct
13021    acactaaaga tgatgttggg tgttaaaggt attggataaa atacaatgaa tgtttctgag
13081    ggctatcatg aataaactga gggctgtgga ctaggtcctc tggggtacat aaacttacag
13141    ttattgccat gttatatgat gtgctgtgga agtaactaaa gagaccataa aggtgaagct
13201    caggagagca ctgcagagcc gtgactttgg tgtgagtcct aaagaccagt aggaagtcat
13261    cagacagagc tgcagttttg gtaaggggcc ttcctagccc atggaacagc atggcaaatg
13321    tgccttcagg gtagacccta gggagtcttt tcaataaaat aaacatgacc taccaagttc
13381    atgccatcaa gatggcattg tgcctaacac cttagcagca cgtcatgaga cctgaaaaca
13441    cacttagtac ccacgcggct tctactctct tattcaRaga aagcatccag agctggaaac
13501    attttgcctt gtttgaactc acaaactaca ggaaaggagt gctggaactg tggctcccaa
13561    aggtctgttt cattattctc tttatagtct tcttaactgc acaagtgggg aatgagttga
13621    aagttagaac tgcccagctt aagggcctct tgctctgaag tgacttggag aactaacagt
13681    tccccaggca gctaaaatct actgaaccta ctgtagatct ttcagtaaaa agtttagctg
13741    atgaaaagtg tggttttttaa agcaccattt gtggctcagg tccaggKttg aatgatactc
13801    cttatttatg aacttctgta tagctgctgt ctgtatggcc tcttgaagga taagccacag
13861    tgaggccagc ctttttctta aatagggaatg agggcaacag gaSaacagtg aattgttagg
13921    gggcaaacca aattggcatc attttcttttg agcaaaactg tctcttactt ctgggggagg
13981    ccccgagcat cccacctgtt cttgcgaata gaggatgtcc atcccaactc tctcttctcc
14041    acacacccat tccctgttcc ctaccccctc atgattcact agattaatta tgcaccacac
14101    tgaagtgatc cccagggtca tgccatcaga ccctcatcgc tggttacctg ttgccaaaat
14161    agtccaagtt cccatgccat tttccttca tctatttgct tatccccata ttgcccagtg
14221    tattctctca tttgcttcta tctccaatgg cctcccctg cctaggactt ttccattatc
14281    ccctctagat cttacaatgc catcaccctc ccctatgtcc tcttctctga atcatggttg
14341    cctcctgaag acacMatctt ccctgcagcc ctctcaagcc tagctatctt cctctctaca
14401    acctgcgtat cattggcctg aaggggagac atcttgcttt gctatttgca gctactttca
14461    gacctttaat ccttcttcct ctctaatgac cttcttacaa gcacatgtct cctttatcatt
14521    gactgaatat tctagcacct aacccactca ccctccccac tcatactcca ttccaccatct
14581    tggccactca gctccttgac gacttttgaa aatcttgttc tgccgctgcc tgaacatcag
14641    ccaccacact catggttaca ctgcgtactg tgtcatgact aatcactggc atcgccaaca
14701    gttccatttc aagcatccca cgctgtggtc atcacttctt ctctctctag tcactcccct
14761    tagcaccatc actccaaatt ggtaagtttt cagcgactat catccccat ttcattactt
14821    ccctccttga ccagcttagc ttctatggtt ccttctcata attattctct tgccccatt
14881    tccaaatccc attatgtact ctcccagcac tgtactactc ttttgagaat taaaagaaa
```

FIGURE 2-E

```
14941   caaattgcaa ctctagtaat ttttcttac tcttaacctg tgcctaaaaa aactaaacat
15001   gactggagaa caaaagacca ccaagttgac ctgtgttcct ttgtatttat atKaatatgg
15061   ctcacatggt tttcatcact gtccagtaac ttattgtcac agtttccaag gtcaatttca
15121   cacttctcaa acttccacaa actcttcatt gtctactgac aaccttactt ctatctttac
15181   tgagacaaca aaaaaaaaaa tcagatgagt atgtacttat gcccatcacg tcaccgtatt
15241   cccaaactac ctgcctctgt gcacaccacc tcactgcctg ctgcagttac tgtccagggc
15301   cagcgcctct gcccatgtac tggagcctgt ccctccaccc ttttcaagca tgttactcta
15361   tcaaataaat atcccttttct cttttgcatt atcagttttg ctatctctct gttggcccca
15421   ccagcactat tacccatgct atattagctt ttaaaaaaWt ctctcaatct cacatttatc
15481   tccaacgttt acatcattct tttgctgcac tttgtagaaa aatatttga attttctgta
15541   tctatttcta cttccttact tcccatgttt tcttgaactc actcgagtta ctcttttctt
15601   gctcaatact ggatagaaac tgctctcatt ggggtcatcg atgaccttca aacagattta
15661   gtccaactgt gaatcttcag ttcccatttt actcagcctc tcaataacaa tccgcccctg
15721   cccattctct cacttttgaa acaccttctt tacttggctt ccaggacagc acactcctgg
15781   ttttccctct acctcactga acattctgga atacccctcc gttttctgag gtctgtatgt
15841   tggagtgaga ggcatctcca tcttttggttt tctcttcttt aactacactg tcttttggtg
15901   ggctcataca ggctcttggc ttttaatact acttataaac tgattactct cagatttctg
15961   tttcagctca ccctcttcct tgaactccag cttataagac actcctgcta ctccacgtgg
16021   attttttttt tttttctttt ttttttttgag atagagtctc actctgtcac ccaggctgga
16081   gtgcagtggc ttgatatcgg ctcactgcaa cccccgcctc tcgggttcaa acaattctcc
16141   tgcctcagcc tgagtagctg ggactacagg cacatgccac cacacccaga taattttttg
16201   tatttttagt aaagatgggg tttccccatg ttagccagga tagtctcgat ctcctgacct
16261   catgatctgc ctgccttggc ctcccaaagt tctgggatta caggcgtgag ccaccgtgcc
16321   cggcctccac ttggatatct aataaacatc tccaactgat attccaaaaa caaacatgat
16381   tttctcccca atgtttttct aacccattgt tcatcatctc agtcaactgt accatcattt
16441   acttcatggt ttaggtaaaa gaatctagag ccattctgac tctcttgctt ttatatcaca
16501   atatcaatct atcagcaaat cttctcagct ctgccttcac aataggtcca gaattcaaat
16561   ccttctcacc atctccttt cctagtctaa gccccatcat gtcttctcgg attaatgttt
16621   tatcctacga tggattttt tgtccccatt cttatcttc ttcctaagag tcctcttttac
16681   tcagtagcca aaggaatcct tttaaaaaga aaatttagct tatatcattt cctttttcaa
16741   atcaaccac catcttccca tatttagaat caaatctcaa gatcttgcca tgctctgacc
16801   cctgcttctc tctccaattt catttacaat cccatttact cttgttcatt ctgctttatc
16861   cacaagactc tttgccccct cttgtctata taaacaagct ctccctccaa agcctgcccc
16921   tgctttctct tcagagtctg aaatgccctt ctccgtgtca atagctcact ctcacttcag
16981   tcaggtctct gagcacttat cccctcttct gagaggcttg ccctgaccac cttgtctaaa
17041   atagcatccc tttcccacct tactttttaa cctgctttgt ggtcttcgta cttacctcta
17101   tctgacttct ccactagaat gcagaccatg tgaaggcaga tttgctgact tcatcacatc
17161   aactatgtgt acctagaaca gtccttggat ggttgacgtg cttgataaat aaatatttgt
17221   tgcatgaatg aatgagtgaa tatttagagc tctatgtcaa atttctggtt cagatgttca
17281   gggatgttct cagttggacc ttttaataaa aaaaaacaat aaatgaccaa attctacttt
17341   aagttatttt agggttccaa cagtcaccca tagactgaac aaactccgaa gatttggctt
17401   catgtaagaa tgtcactgca aagaagcttc agtacccatt gtgatatcat ttgctaattt
17461   ggagattgtg atgccaaaag tataagcccc atgctcagtc agcatctagg tccaatagct
17521   ctcagaggaa ccatacatca aagcaaactt tctgcaatgc ggaaaagaac atccatgcat
17581   ttttaaaatg aattttaaat tttaataat tttaaaagt ggtttcatct cttgtaatgg
17641   aaaatattca aaattctcat gctgattcat gaagtatact tatataatta gacaaaataa
17701   gaacattgaa agaagcagac tccttgtttc atcgctttaa gcaaataata aaaatggact
17761   cRtgcaagtc acaccactaa tttaaataca ttttgtaaaa agatagcaaa taaatgaaat
17821   aaaaatattt gctttagttt ttttaaacaa agatttatta actctgaatt tttaggtta
17881   aggaccatgc aatatatatc tcctacaccg aagtgtccaa gaatgttttt tggagtaaat
17941   taatgaactg ctttagaatg ttgctcagaa attaagctag aaattcagag caatattctc
18001   agggcttgat ttacaccaaa tccaagttcg caatgtatta acatgaagga ataggccatt
18061   gctttctgaa aaccttcctt ttataaaga aatactttaa tattatgaat tctcttggtc
18121   tgtgtaaaat attatttgca ttataaaaat tgatttttg gtataattgt tcataggcaa
18181   tattttcacc aggatgggtt cacaagtgtt aatggaaggc gaattatgtg tgggacagtg
18241   ttctagggaa tatgtgaggg gtttttaaga tggataacat tttgtacctg cttttgagtt
18301   gcaaatgatc tggactgttg gttaaacatc gcagacaaga tcaggtgaag aacattacta
18361   gaagttcagt gattaagaaa taaagccacg taccccacgg agtgaaattt gaattcctta
18421   aattccctca aattattta tgttggattt tacaccagga taggaatgtc tttaaaagta
18481   agaaatattt gacataaggt agaaaatttc aaaggagtgt ttgacttgtt gctggatgtg
18541   tcaccacatt tcatgtgtct gagaaatata aatttctaca gcacatttt agtgccttaa
18601   acagactaca atgatgtaaa tggttgaaca gttgaaattt agtctggaac tgggacagat
18661   gacttgccac atagagtggc tcccaacata aagtgatctg tgatggcagg actttcagcg
```

FIGURE 2-F

```
18721  tgtttcacta ttagcatgtg tcatccaagc atgcctttca acatctgtgg agaaaagaca
18781  tgttacaaat acaaaacacc accatgatga attgggaatg tcaaaaacct ctgccttggc
18841  tgtgatccag tgttgttatt ggcaagtaga ttcatccttc taggttggtt gctccataag
18901  taatcttcaa gaaaagcaag tccaacaccc tttttctcc ttactgtgaa cttggtcaaa
18961  attaccaaat gtttggtaac catttatggt atcaggaatg caccaataac tccttctgac
19021  tctttaagag caatcatctt gtggaatgca atttcccttc ttattattgt gggtattttt
19081  aggtacctat gcttgacctt ttttaaagag agtaaggatc tgtgatttaa actaggatag
19141  aagctgttcc agagataaca aaaagctgtt gctttctata ttccaacagg aactaggtaa
19201  aacgataaat gtgataactc aaaataatgt gtatgtttat cttccaggct ttctaatagt
19261  taattggtta aataaaacat tatttacaga aatagaagag ccactcctca actgttcaaa
19321  cactgcaaag taaactaatg caagtgcagt gacctcttca tccagccaca aaatcatata
19381  tatttttaat tctccaagga gtttgagata gtaaagttgg atatcatgta gctaaacaaa
19441  ggcttttacc ttttctcttg gaaaatagtt aaaatgaata gRaatctgat aattaatctg
19501  ggaaatttaa ccctgctcta cttacctaat gccccccaa aagatgatct ttttttcttt
19561  cattgatttt ataccttaaa aagaaattac tgaattgcag atatacaact agtatctaca
19621  gacagaaatg Maggtcagtt ttagaagaaa ccagtgtcaa atgaaaacac agatttctac
19681  atggtcacat tcatatcaca cactcttgac ccaaggtgag aaagtaggtc attccttatt
19741  tcttatttat tccctggcac aatcagacca cactacaagt ttcttttacc agttgccaaa
19801  atgaaatcat gacacccttc agagctactg tcgttacatg caactcaaga caacgagcag
19861  catcataacc attgtcaaca ggcaaactcc aacaatgtct gggtttggat ttggttttat
19921  gttgagagaa gcagatttcc tctgatttta ataatccata agaaacagaa atcataatat
19981  attgactcca tattacctaa aaagagtcaa aagaagcaga agttctcccc cgattcatcc
20041  tcttgttcca cagacatttt gaaaataaaa gaagacaaaa tagaaaggaa agggtgtgag
20101  aaagaacaca gaaatgactt gaacgatttc aaatccttat taagcatcac tgaggttgca
20161  ttttacccat tagactgact gaatttagtt ctcactgctc agaccttgca aagaaactgg
20221  acgtacatgg ttttgccttc cagggttgat ctagaactgt aagggtgcat gtgaatgtgg
20281  gtatgcatgt gtgtgtgctt taagtccatt ttataaacac tgacacaaga caattctcat
20341  cattggtaat agtctttgga gtccaatcat gcagaaaaac aggcaggtgc aagttaggtc
20401  tcattgcaag atggacatgg caaggtgaac agataatcct acataaggat tgggagattt
20461  gtgtccatta gaatatactg gccattggtc ccacataagt aaagttacat atacaagatt
20521  ctatatataa acagaggccc ctcacttcag tttggctgac caaagaaaca ggtcaaagtg
20581  agccattttc agatagttaa aggactaagt accaaaagaa ataacaaaat cttatcctct
20641  aatcacaaag aaaatagcta aaataactat ttacattgca acttttttgt tgttttaca
20701  gagaggagtt tccttgcttg gcttaatgat atctgtggaa aatgttgaac tcttataatt
20761  aaaatgtgtg tggggattg tgagtgggga gttgggttcc tctttggatg caaagtggct
20821  gagatcaaaa atttctagag caatttact cctctttctg agctgtagaa gaatacattt
20881  ttcagcaaag ctggctaata acatgcctta cagagcataa tgcacttaag atgtggcttt
20941  tcatatgtta agagattcaa atcgaaatag attttgtata atttaggttt tgcaatgaat
21001  atttacaatt ttaaaacaaa tcaagtttgc ttattttttt ttccttgaca ggacataaaa
21061  ggttttacat atttttatct atttttact agttccattt actaaggcca actttcagtt
21121  ttaccagtca gctgctatca gtgtctttag ataatttttt tctgataaca gattgaaaaa
21181  actatcgagc ttcttaaccc tcaattaaat agcttactcc aattggtggg aactggccag
21241  gctctggtcc aactgttggg tacattccta caaaactcag tcatcagatt cttgaagatg
21301  aaaggttatt atcagttttt attccacaag aagaaattcc gttgtaaggc tagtgtattc
21361  ctatttaaaa ttgaacacgc tgacccacaa aacacatata aaaatagtaa agacatatta
21421  atagtaaagt ggtggcggtt ttgccaaact cttgcagcag tttaattttc cctgcacatg
21481  agtacacagc catccttcct acaaaatact gcaaactatt ttattaagga tcactgcaaa
21541  ccaactgccc caaaggaagc ctaacagaag gttaggctcc tcagagtgcc aacttcatgt
21601  tccaaaatga gccccaaccc caggtagaac cttcactttt tttcaggaat attgtccagg
21661  tgacttgaca cttgcctacc ggaaaagttg ggatgttctt gggaaataac aggtgactat
21721  ttaagaaata tttggggtgt gtgtgtgt gtgtgtgt gtgtgtgt gtgtgtta
21781  agacagacag gtgaatgcag aacatattat attctgtgaa tttgataata tcatcacctc
21841  ctagacatat tataggaaag cagacctagt gggcaaagga ctgggggct tttacagttg
21901  tgattctctt tgttgttcca tcatctgcct tgctttaatc acctaataaa actgatcctg
21961  caaaaattct gggggccaaa tccttacctc tatttgtaaa tgatacttat attcaaggaa
22021  tttgttccat ttttctcttg tccataaggg aaatctggct aaagctaacc agctcccaag
22081  agccatgcac agaagatgta agactaattg agctttggga aggtactaac agcgggggag
22141  gggccctgtc tagttcttgc ctggtttacY ctgagggga aattcaccac ttatgcaggt
22201  acgagagata gcctgtcaag cactttgaag atgctggctg gagacttcct tctgtcttgt
22261  gatgtcatct tgcggctgat gaaattcccc ttgagactct ctttaaagca gcttcctgct
22321  ctccgcactt aatcccatgt ggtataaagt aagggagggg aagccaca gatatatcaa
22381  gagaaaagta ccgagaaaga aaatcagtaa agaattagag atacagagag gagaagtttt
22441  taaaaaaaaa aaaaaaaaac aggaatatga aagagaggga gctcaagtga ctgaggaggc
```

FIGURE 2-G

```
22501  attttttaaca atcaggttat ctgcaatatt aaccagaaaa aaaatggtag caaaatagag
22561  aaaatgggcc attttttattc caggggacaa gctgcacaaa ggaatgttct tctatttatt
22621  ttaaacaaat gactgcgtgt actgaatctg actgtgtgaa ataatctcag aatggcagca
22681  ccactggYat ggcgatggtg caggtgggtg cagttccctg tggtctctat tgcttgaaga
22741  gagaaagRaa gttccctatt attatattta aggcagtttt cagagcactg gcattcttgt
22801  ttgctctgtt ttggggatat tctatttgcc aatcagttca cactcatcaa ccatccactt
22861  cctgtctttc acttcttcag gtgaaatatc accactctag tgagcaccaa catggtcaga
22921  gtgcaaataa ctgtgatgga tacttcgaag tgaataagaa gggaagcctg attattgctg
22981  agatcacctt ggtattgcct tgtacataac caagatgttt cacagtgcct ccttaagtgc
23041  tcaggaaagc actttcattt aatttaattt aagctaaatt ctggagattt tgctaaacat
23101  tgacattaat gcttcatggc ttttaagaca aactcatatt gctaaaacta tttggcagca
23161  gtaaatttat gggcagagtt attgctctta catctactgc agtacaaaac tcagatgatc
23221  agcccttcga ttgctcatac ttattaaaat aaataaataa acatgaaaca tcagccacat
23281  taaggagtca gggaaactcc tgaggaataa caatgtctct ggagatgttt tcaaatgcta
23341  acctgagact cacactgtgg tttgggggtt tcattMttat tattattatt ttatttcaga
23401  agaggaaagt aatattattt ctcaaaataa aactttggca gagtatgaat cagggaagca
23461  gcccacacat ggaaaacaca atccacaatc tgaaagtagt ctaggcaggc tcattttttt
23521  gttgaaggaa ttcacatgga ggcaattctg ctcagttcca gagagagatt cttatcatca
23581  aaagcacaca caataacctt gcttcaccac ctgccacttt ctccagtggc ctcttgttgt
23641  gaccagtaat tgagaaatga caaatgggta tagagccaaa tctctaaaac agggacacca
23701  gtgtctccta gtatctgggt aataacctcc tttcagtctt agtccacacc acacactacc
23761  ctccagtctc tcctactctt tactgtcaca gaaaagactc tcagcttta ttcacacctg
23821  ccttcWgaag gccaaaccat tttgtgcctg aaaactgtta cccactcScc ccacacttta
23881  cataagtatc acatatgttc tttctacaaa ttggtataca ggtgccattt aatccattca
23941  aatttggaag ctacatcttc aagggtctga gagagctcac tcccccata tattccccct
24001  ttacatgttt tcttataaga catacagttt aatcaattaa caaactaaac agcttatata
24061  ctggcaatat attacagatg ggtttatgtc agagtaatag atcacatgaa atggaccatg
24121  tggtaccca gtgcattatg tcttggtaga gccYtgagga cactgacagt agcatctcta
24181  agtaagtagt gctgtatgaa tacagacaca tgcggatctg tatctacatc catctgacta
24241  ggccaaggag caggtagtga caagatagag acacacacat gctggatggg gccactgcac
24301  accttgtcat gccatttaaa agggcagtta caggttgccg gttttgcagc cattaaaatt
24361  acactttatg gaaaaggctt ctctaattgt gtctgatttg ctttctgtag taagcatcat
24421  tggaagaaga ccaaagcaag agcaactaga agttaaatat acatttgagc ttagctgcaa
24481  tacagaaccc tggggaagaa gcaggctgaa agatttattt aattttaggc ttggattctc
24541  tcccttgctg ttttcttgat gttgtgtgtc tgcatttgtg tgtgtgtgtg tgtctgcgtg
24601  tgtgtgtgtt ccatcacatc atctcctgaa gaacgctggg tttcgcaggc aggcggctag
24661  tcacctgcaa caacccaggg gtcctgccga ggcttccagg ctgctgtcag tgtcagatgc
24721  cagggtctgg tcggtggaca tggaggagat gtcattgaca gacgaggatg gagggagact
24781  ctcactgctg ttcactgctg cacctgtgct aagaaaatga agaccaacat gactcaatct
24841  agaaccagac ccatcttaat gccattcagg attcagggat gggcaaatac aatagggat
24901  gtccagtcca tcaatcattt ggcaagcctt tatagagcag ctgacatagg ggagcatatc
24961  aaatggtgac aatcaagaca tagcaataaa aagtccttca tcacaagtta tcaaatctca
25021  ctctatattt gaaatcacct gcaacacttt ctattaaaaa acactaatat ctggtcacat
25081  tgcctcccct gccccactg cactgcatat attttaatat aattggcctt gggtgaggcc
25141  aaggtatttg catttttatt tatttattttt ttttgagatg gagtctcgct ctgtcgccag
25201  gctggagtgc agcggcacaa tctcggctca ctgcaacctc tgcctcccag gttcaagcta
25261  ttctcctgcc tcagcctccc gagtagctgg gagtacaggt gcgcaccacc acacccagct
25321  aatttttgta cttttagtag agatgaggtt tcaacatgtt ggccagaatg gtctcgatct
25381  cttgacctca tgatccgccc acctctgcct cccaaagtgc tgggattaca ggcgtgagcc
25441  accacgcccc gcgggcattt gcatttttta aaagctcctc agagactgta ttcagccaag
25501  cattgaaagc ctctggctta tgcaggagac aaataagcaa aacccttaa tggagccatc
25561  tgagcctggt tgtttttaat gcagggagct tttaaaacaa acatatgcaa gggtcctatc
25621  ccagaaatag aagctgaagt gaagttcaga aatctgaatt acttggggac cacatctcta
25681  gagaaaggaa gatatataaa tactattatg tcatcattaa tgacacataa cttaaaatgc
25741  atatagaaaa gccagtagga cataagtagg actgttgatg aaagttacaa aaaaaaaaaa
25801  aataggagaa gccttagcac agcttttgct tatgagctaa ctctccagca ggcttgctta
25861  cctgggatct ccaaataaga actccaaatt attaacttag attaacttga aaaaattgtt
25921  tatctgttat gcgggagtat aaggttgaaa ccctgagaag aaacctgccc aYggtaatca
25981  ctcagtaaag gctagctgag ttgccagtag ctttgagatc aacaaaagaa agatgaacca
26041  aaggcattgt gcgataYaat taaccagag caccctggaa acaatccatt tacttttttt
26101  ctttgtatat tcttttatacc taagcaatct gagtggtaac acacttgctt tgtgaaatag
26161  ctcgctatta aaaatctgta gtatagtccc ctaatcaaat aagagatgag gaattctcac
26221  taaaattata tcttattttga gcaaatatag tgtgcaagat ctatttggtg aaaaataata
```

FIGURE 2-H

```
26281    actccaaagt cagttataat agtgttatca catagaccta ataaatcaga aagacaaaat
26341    aaaactaaat taaggaaggg Ragtggttaa cataatcctt gctcctggag tagacatttc
26401    ttgcctgtga gaaaagtgtg atgaaaatgt atcagttatc tagagaggac acaaacacct
26461    aaactaagac agatcacctg tatcttccat gtatttttaa gttgtatttg ttgactataa
26521    atatatggac gtactctatg ggaaatgtga aaaaatatag gaaataaaga taatgatatg
26581    caccgatctt caaatataaaYg gtaagaactg ttaaactttt catatatttc ttcccggtca
26641    ttcttttttgc ctggaagttt ccctggtcgt gatcttttaa tatgtatttt tttgggatct
26701    tgatatttttt aKatacagaa aagcttatga atttttcatg ttctttaaac tcctaaaaat
26761    acccatcctt tctaatctta aatgtctcta gaaaaggttt ttaaagtcct cYtgttattg
26821    tctttctgta aataattact ctatcaggac aatgtataaa gttataatat tccataatat
26881    tccaactttg aatggcttta atttattcca actttactta attatatccc ccatagctat
26941    ggtacagagc tggttcattt cccctcatga taagatttta tctcctagca gacagccctt
27001    ggttcctttta cattgcccaa atgccctgct ctgtttttca ccccgattc tggattaaat
27061    tataccaaYa tccttcatat tctttcataa gttgctaata atttagtgtc actatgatgg
27121    actcctcaga attctcttcc atttatccac actcttatta aaagacagag attaaaactg
27181    gacacaggac tctattataa aggcctgatc aattgtgagc ctagcagagg gaaattgctt
27241    ttttctact atttgctgc tggatgacat atccctagac tatgatgcc tttcaaatta
27301    tggtgctaca gcttaaattta gttttgactt gaggtataga atgatgctca tatatttttt
27361    gtaacagctt tattaagata taatccacat atataattaa gaaatttaat tttcatgatt
27421    cagtgttttt tagtatattc acaacattgt gcagccatca ccacaatcca ttttgcagca
27481    tttcatcatc cctaaagaaa accctgcact ccattcctca cctaccctgt agctctaggc
27541    aatgactcat ctacttttg cctctataaa attgccttgt ctgaacattt catgtaaatg
27601    gaagcatatc atatgtgatc atttatgact ggccactttc atatagcaga atgttttaa
27661    ggcttatcca tgctgtggca tgtatctgta tttcatatct ttgtatggct gcataatatt
27721    ccattgtatg gatacatcac attttgttta tttattagtt gataggcatt tgatggatat
27781    ttaggttgtt tcaactttt ggctattaca aataatgctg ttatgaacat tcatgcacga
27841    gttttgtatg gacatgtgtt catttctctt gggtatacac ctagaagtgg aattgctggg
27901    gcatagagta attctagctt taacacttga ggaactgaca aactgtgtcc ggaattggtg
27961    ggttcttggt ctcactgact tcaagattga agccgcggac cctcgcggtg agtgttacag
28021    ctcttaaggt ggcgcgtctg gagtcgttcc cttctgatgt tcagatgtgt tcggagttc
28081    ttccttctgg tgggttcgtg gtctcgctgg ctcaggagtg aagctgcaga ccttcacggt
28141    gagtgttaca gctcttaagg cagcgagtct ggagcttttc gttcctccca gtgggctcgt
28201    ggtctcactg gggtcaggag tgaagctgca gaccttcgtg gtgagtgtta cagctcataa
28261    aagcagcatg gacccagagt gagcagtagc aacatctact gcaaagagca aagaacaaag
28321    cttccacact gtggaagggg acccaagtgg gttgccaatg ctggctcggg cagcctgctt
28381    ttattctctt atctggcccc acccacatcc tgctgattgg tagagccgag tggcctgttt
28441    tgacaggtg ctgactggtg catttacaat ccctgagcta gatacaaagg ttctccacgt
28501    ccccatcaga ttagatacag agtatcaaca caaaggttct ccaaggcccc accagagcag
28561    ctagatacag agtgtggatt ggtgcactca caaaccttga gctaaacaca gggtgctgat
28621    tggtgtgttt acaaaccttg agctagatac acagtgccga ttggtatatt tacaatccct
28681    gagctagaca taaaggtttt ccaaggcccc accagagcag ctagatacag agtgtcgatt
28741    ggtgcactca caaaccctga gctagacaca gagtgctgat tggtatgttt acaatccctg
28801    agctagacat aaaggttctc caaggcccca ccagagcagc taaatacaga gtgtcgattg
28861    gtgcactcac aaaccttgag ctaaacacag ggtgctgact ggtgtattta caatccctga
28921    gctagacata aagactctcc acgtcctcac cagactcagg agcccagctg gcttaccta
28981    gtggatcccg taccagggct gcaggtggag ctgcctgcca gtcctgcgct gtgcgctcgc
29041    attcctcagc ccttgggtgg tcgctgggac tgggcgccat ggagcagggg gtggtgctcg
29101    tcggggaggc tcgggctgca caggagccca tggagtgggt gggaggctca ggcatggcgg
29161    gctgcaggtc ctgagccttg ccccgcagga aggcagctaa gcccggcga gaaatcgagc
29221    acagcgccgg tgggccggca ctgctggggg acccagtaca ccttccgcag ccactggccc
29281    gggtgctaag tccctcactg cccggggcca gcagggctgg ctggctgtcc cgagtgcggg
29341    ggcccgccaa gcccacgcct acctgcaact ccagctggcc cgcaagcgcc gcacgcggcc
29401    cgggttcccg ctcgtgcctc tccctccaca cctccctgca agctgaggga gtgggctcca
29461    gccttggcca gcccagaaag gggctccac agtgcagtgg gggcgtgaaa ggctcctcaa
29521    atgccgccaa gtaggagcc caggcaggga aggtgccgag agcaagcgag ggctctgagg
29581    actgccagca cgctctcacc tctcaaaact gttttctaaa gtgggtgcac catttttacat
29641    tactaccagc agtatatgag gattccaatt tctctacatc ctcaccaaca cttattatct
29701    gtctttttat ctagccatcc tagtgtgcat gaaatggtat ctcattgtgg tttgatttgc
29761    atttgcctga tagctaataa tgttgagtat attttttcat gtgcttgtca gccattagta
29821    tatcttcttt ggagaaagtt tactcagctc ctttggccat ttttaattg ctttattttc
29881    ttttttattat tgagttgtaa gctctttagc tcttttcttcc tttctttctt gctttctttc
29941    ttctttattt ctttttttaa ggacagggtc tcagtcgccc agcctgtagc acagtggcat
30001    agtcatgttt cactgtatcc tctaactcca gggctcaggc aattctcctg ccccagcctc
```

FIGURE 2-I

```
30061  ccaagtagct aggactacag gcacatacca ccacacctgg ctaattaaaa aaaagatttt
30121  ttgtagagac aggagcttgc catgttgccc aagctggtct caaactcctg gcctcaagtg
30181  atcttccgat ttctgcctcc caaaatgctg ggtctacagg catgagccac tgtgacaggc
30241  ctgtaagagc tctttatata atctgggtac aagttactta atgagatatg tattttcaaa
30301  tgtttttcct ctatgctatg gtttatcttt tcattttctt gaaggtgtct tttgaagcac
30361  acatatttt aattttatg aaatagcatt tatctgttgt ttctttatc acttgtgttt
30421  tagtgtcata tctaataaac cattttctaa tccaagatta taaaaactta ctcctatgtt
30481  tttgcctaag agttttataa tgttagacct tatacttaag tctatgattc attttagtt
30541  cattttgta tatgatatga ggcaggggcc caccttcatt cttttgcatg tatatatcca
30601  atcatcccag caccatatat tgaaaaggct attctttgtc catgtcttac atccttatca
30661  gaaatcaatt gatcataaat gtaggtattt attcctggac tctcaatttg attccgttga
30721  tctatttgtg tatcttcatg caaatagcac tctgtcttga atattgtagc tttgtagtaa
30781  gttttgaaat cagaacatgt aaatttccca gctgtgttgt ttttcaaggt tattttggat
30841  attctgtatc ctttgcattt ccacacaaat tttaagatgg ggcttgtcaa tttctgcaaa
30901  aaagacagct atgattttga taagtattgg cttaatctgt acatcaattc ggggagtatc
30961  tgtcatttct tgacaatatt aaatattcta atccatgagc aatgaaatgt ttttccagtt
31021  attagatcct ctttaatttc tttcaacaat gtttcgtagt tttcagagta caaaacttgt
31081  acttctttg ctaactttat tcctaaatat gtatttcttg atgctattct aaatggaatt
31141  gttttatgtt cattgctaat gtgtagaaat acaattatac tgaggactta tttgaataag
31201  aagtttcagt gtcagtggat tggatgttaa aaacagatca aatgaatata tatatatata
31261  tatatatata tatatatata tataaaatga atgttgtaat taactagaaa gccagtggaa
31321  ccaggcgatt atgatagcat gctttattta tgagaaaata accagtttta aaaataactg
31381  gttttatgag aaaataacca gttttaaaac tttaaaaagt tttaaaataa aattgtggca
31441  taatacaaac caaaaagtat tttaagtct ttaataataa tcttggtctt ctcttgagat
31501  aggctttttc ccctatcctg gctggagttg attatgtaga cacattctta ttgtcacaat
31561  taaagttgag taatgattca ataagggtg agataagtct tagctgaaat aaggctccct
31621  tatagtaaaa caatttgatg tttacaaata aacacaaacc cacaacaatg gcagctagag
31681  aaattaaaca aagagcattg aagaaatttc tccaaaacac aaatttatat ctacaaataa
31741  tattgaatgt atgtaacaaa agccaaagta gcttttaata agctcttcat aaacaggatc
31801  gtgctgcagg ctatgcttat aaaacacaca gcactcctac tgcacttatt ttcaaaatca
31861  gcatattttc agcacacttc tggaatattc cgagtgttat gccataccag tcagcccctt
31921  attatatgta gttttgttat ggattacctc aagcatatat ttcccctgct tcttttact
31981  gctttcatta tacttcattt ctcctgtctt ccacaatgtc tactgctgag tagtagcaca
32041  gagtaagtat tcgagttaac aaaacagtat tgagtatctt atgtgtactc ttctagatag
32101  gttctgtgag gaaaagcaag ttccttcctg ctttccaact agtgaaactg ttaagctatt
32161  tttggccaaa ggaaatcact tgttgcagt tgtcttctt ctccttttgt tcatcagcag
32221  cttctctcta attcctatcc tctgtgttgg aatggtcctg cctctagtt tatcaatgtt
32281  gaatgcaaat ataattagtg ttcaactact caaagttcaa aatctatcaa agtctttatc
32341  agctgtattt ctagggatcc atagactatt gcttctgatt ttatatggca caaattcatt
32401  aagagaagtc ttcagtgctt Yctttgtaaa agttcccatg acatctgctt gtttcatggg
32461  aatggttcct tgctatccag tgtgatggtg ggagagaacc gtgcactgtc tatggtgtcc
32521  tggagctggc ttttagtggc ttcttagaac gaattattag catctctttc caactctgca
32581  tccattgatg ttacattgtt gcttaaaatt ggtcacagtg agaatattta taccacagga
32641  attgttaagt gctactagtc aattcttttt ttaaatatag ttgttaaatg ttaaccagtc
32701  caccactatt agatgaaaac tatttgcttc tgtatgactc cctctattgc gctataataa
32761  atgcctcctt gcctgcagcc acttctgtg gatgatccat tcaagtctat tttcatgtag
32821  gcaataaaca ggagttctaa accataaacc caaacacaaa cgtaagggac aagacatggg
32881  ccttggcttt aagttgttaa attactgcca agcagtttgc gaaaatctct taaacagaat
32941  tgaactgaat tgaatatgat cattgtgttc agttgtccag tcaatgtgag aaatatctct
33001  tctttctata ttatttaaga gaaaacagta gagatacaca ttttcaaaaa tgttttgcca
33061  tcaataaagc attacaaatt tttgtctata aaaatggcat taaaaggaac tgaaaatgtc
33121  aatagggttg caaatgagga atattagcta ccttcaactt tacctaaaaa atcagatttc
33181  atagaagaa gtaacatatg ctaaagaaaa tttctcagct acaagttatt caaccaaaaa
33241  acattgttat ggggggaaaat gttgttctgc ttttttaaa ggcaatgatt ttcctgataa
33301  cccccaatcc caacaacaac aaaaaaatat ggtagacaca gaattagaaa aagcacaaga
33361  atgaaaaaat agtgtctttt ttatctacat gatcttgagc cacaatttgt ctgggcctga
33421  gatttttaa taaaagtaa ataaaattaa tggactatat tagtgaccct aagcacatt
33481  cccatggtgg ggaatgtggt cctcactggg gagagaatgg ttgcatatta aaatcaccca
33541  gaagctttat ctttgaYtta gagatttga aaatctctg cccatcctgt tgttcagcat
33601  ccttatctta gtgagtcact gttagttttg ggagctttac ttctcaggtg gaagagggct
33661  ggtgaacaaa ctcagaattg gtgaatcaga tgctctcctg tatttttct agttctaacg
33721  tactataaca aatgctttta gaagaaaatt aatttcaatt catggactgc tagtccctca
33781  gcaattgtta cagatcaatt caggaagcaa gcagctatgc catccttgaa aataaattac
```

FIGURE 2-J

```
33841    tatgcaagtg aaatcagata gcagaaggga atacaattat ttatttggaa atgtatctga
33901    agtttagatt tatctcttat tgcatacaa caatttcatc aataaatttc aaacctataa
33961    attattctgc aaatgcacat ttaacttcct atttacattt taaaagcatc gcataacatg
34021    ggtttcgtat tagaagtact tggccctga gatactgcat taacttactc ccttgctgca
34081    gaattcccag tattgccata actgaatact aacagagtgt gtgttataaa aataccacag
34141    ctattttcaa aataaaatat gctacgtgaa cattaatgaa aaaagctga atataatgaa
34201    caatgcaaaa aagctgactt ttcaaacttt tttttagaat tgcttttct ttccagcata
34261    gtttattata cacacaaaaa cgcatacaca cagtggtgcg ccaataaaaa tttaacaatt
34321    ggctctgcag ggggcaacaa aaacgccctg atttgtaggg tctgccaatt tccatgttgt
34381    aaatccttcg tgcctgattt cacgttgcca acacaccaac aataaatgca tagttgggaa
34441    gagaggtaca gagttggccg tcatgagctg gtagagtcag cgccagcaca tggctgccct
34501    agagcctctc catcatgcac ataaatatgt catacagaaa tgcatcccat aatgtgtagc
34561    atacatatga tttctcacga aagagaaagt catactacat gacttataac taagtcatga
34621    atatttttcc tagatttaat ccacaatcat tttaactata aattggttaa gccagtcaac
34681    tatagtttag ggcatatgta ttacatagat aatttttaat tgttaaggta gttggaatgg
34741    ttaaaagtg gcttagcctt ctcactcagg tagagcctaa gttgcatatt ttagaattaa
34801    tcattaacac actaagcagg cctgcaaaac atccatgaat atatatttcc caaaatgaat
34861    aaatcaaaca cctgaaagct gcaaaccttt atgtgaagca tgaaaaaatg ccaatagcaa
34921    gaatttatat actttatgct tggcctgttt atcttcatgg agattaatag agtgaataaa
34981    tatttataat aatggtgtaa gaacatgctg aatagtatac tgtattaaag ttacatgatc
35041    ttgtcttgaa ttttgtgttt ggaatagtac taagaaatat gctgagggag aaattgagtg
35101    gcaattttca aattaatata tatttaYtga gctactacta tgtgcaaggc acagcaccca
35161    ggcactacat gggacacaaa gataaatgca tacagtcttc tcaatgaaat tacaatcaat
35221    aMgggataat aagacaagag gtcaaatatt taacatacag ggactagtag gacctataga
35281    aaggaaagat cctattattt gggaagatat aaaaagtctt tgggataag gtggtatgaa
35341    aaggaaatga agtaatgata acttgaactg aagatgaata gaataggttc tactaaaatt
35401    tgtccaggcc cagcctaaca tgctaggtta cccgtggcta cattctgtta tttctgctgc
35461    ttaatgagta catgacaata tgttctggtc attataggaa ttcttaaaac aaggagtcat
35521    tctgccttag caggtggcat cttgaggctt ttggattctg tcttcaagtt ttttaatgag
35581    caacaggcca aacgtggatt agtttgaagc agcttctgtg gactgtgtca atctgtatgc
35641    gagggtgaat gagtagagag ggtggtatgg aaaacaactc ctgtgattcc cttaaccttc
35701    tttgaggaag ggaaaaactt gggataaaac tgagtatttt ttcaagtcta ctggtgagaa
35761    aagcatgtca taaccgaatt gcatctgttt gggtatcata gtggtttggg gtgtaaatta
35821    gttattcgaa gagtagtatc gatatgaata attgattaat tatttcattc tacatctttt
35881    ttcctaaaat aatttaggaa aacaacaccc taatcagttt ttctcaaaac taggcatttg
35941    tagcccccat ttttgctagc aggagttgaa tgtagttttt aaagctgaaa ataaaccaWc
36001    acattttcta aaactcttta tagtgagagc ataggtctta ggaaaaaata tattagcatt
36061    aataagtaaa ttgtctcaag tcatactaaa gcacattact aggatcagta aaaaatatat
36121    atgcacaatt gtgtattaga ttctgtggct agcaaacgaa aaattttcca agctgacctt
36181    aaccggagcc catcttggta gatgtttcaa ctattgtcac atcaaccttg agaagagttc
36241    aaacactaag aatgaatgag ggaagaggta gcggctgaaa ggattactga gctccacatt
36301    gacttgatgg tcaaagggc attatggctc tgaattttga tgaggcacat ttacccttta
36361    gcccatgtta acatttcttt caggattcat tactattaaa attatttatg aaaaagtttt
36421    tgtRctggat cattaccatc agaataatca gaatgaatgc cacactgaat atcaaaagaa
36481    ataaaactaa aatcattata aggacacaac catgtgtatat ttgtccatct gctctttaag
36541    caatgttatg ttatttcttg caacccctac acaaaggcca agaaattaca caagtactag
36601    tttattggtt attcacggag agtgagtacc tgaaggagaa ggctgtcctt ttactacacc
36661    attttttagtc ttttcttctg aattcattac ttccttgtag ataagttctg taagaaacag
36721    ctgtgttatt atagaaaaca aatttatcct tcatccacag ggaaattcat tacttaatgc
36781    caaataatta cgttttgatg gggttgagta aattaaaaat caattgagat tcctttactg
36841    ctctatttct atttctatat tgccttgtaa ttagcagaga gcctggcaca aataggtatc
36901    tagtaaagca gttgaagaaa tcaatgcatg aaaatttatt tctacgtaca tgaaacatac
36961    tatttatttc catatacata gtatttattt ctacatacat ttctacataa ataacattta
37021    tttctacatg catgaaatat ttctacataa atgaaacaag taatacatgt tttacttgtt
37081    ttctgaattc tttgggggaa gtactaatac attctagctc aatctagcaa caatttttat
37141    ggctttgaac atccattttt ctttatactt atttcctatg aaatgcacac attctcatga
37201    ctttaaatta ttaccaatcc ttacaacttc catctcttac tgcatctttt tttttttcca
37261    gactcatatc ttggacttgt aaatctaaac ttgccaaaaa ccaaacacat taaaaaattt
37321    agttcattta ctctcagact ggcatccatt tttggctttc tgaattctag agttaaattg
37381    gatagtttca gttctgttta ctYtgtccct ttagctaaaa atcattccgc cctactcatt
37441    cttgctttgc aatggcttat aatctgtata atcatcatcc tttacatgta cttcttttctc
37501    caatttctca caatttagtc catgtcctcc tcaaatgatg gttatatcct atcacccacc
37561    tattcatgag cccctaagga gtgccttcct gtccttactt ggatcaaagc aactctttt
```

FIGURE 2-K

```
37621  catctatatc aagcatcttt tttcacttga tccactttt gtatatgttc attttccat
37681  attcaccaac atgaccctgg aatctctgga ccagtggaat ctctttagta tcttttaaaa
37741  ttttttatt ttattttta ttttacatat atatatagag agaggcagag acttctctg
37801  tcacccaggc ttgagtacaa tggcacaatc atggctcacc gcagcctcaa cttcctggac
37861  tcaagtgatc ctcccacctc agcctcccaa gtagctggga ctacaggtgt gtaccactat
37921  gcccggctaa ttttgtatg tttctagcag agacagggtc tcccatgtt gcccaggttg
37981  gttctgaact cccgggctca agtgatcccc cagcctcagc ctcccaaact gctgggatta
38041  caggtgtgag tcatcgctcc tggccctgtt tagtatcttt ataacatttt ctgcttattc
38101  ctgtcctttg ttttcctctt agtcctttat ctgatatttt cttaatattt tttctttcc
38161  taatttacac ttattaattc ctgcaaggta gctcaaatgt tccttcctt cagctcttcc
38221  catttgatc tgatcatttg ctacaatctg catttgactt tctcatattt attctattct
38281  gtagtgattt agattagtag attagattaa taggctactc agatacacat attttctatg
38341  taaattctca agtcttatca atccaatgag taaactcata tattgactat ctttattt
38401  ctaaagtcta aaaccatctc agaattaatt ttaatttcat gcttcatatg atgattat
38461  gtacaaacat agaaagttgt attctggaat tctgaactaa agcttgcccc ccaccatgac
38521  aaacactgac aatcagtacc attttaaaag gtatcgacaa acactgacaa tcagtaccat
38581  tttaaaggt atcaatggta aatgcctttc attcttgagc aaatgtgaca ttgctttcgg
38641  catgaaaaga cagatgaagt tttaggagct ttaaaaatgg tctaagagaa tagcagtcag
38701  caaatcattt tttagtaaat tgttttacaa ggaaaagcct tgttgatact ttctgagttc
38761  aataaaataa aaagtatact tttttaagta gtagacttac cttcccattc ttcaattgtg
38821  tgttctcttt catccaactg cttgtcatat atctgaggtg gaggctgccg aataaaaaca
38881  aaaaataatc tttgtgtgat aatgtaaaca taactaaaact cttacaatgc acgagaatac
38941  cttgccctca tttatttcgg tgatttcaac cgtatataag ttatgaggaa attacagtag
39001  ttcagaagtt aaaattttcc tgtaaactta tggaggattc attcatattg caatatttgc
39061  tgctgaccca atattgctgc aatatttgca gcagaacgca atcccgaga gctcactttc
39121  cgacatcttc tgatttagaa cccacgccta agcaattaat gactggtctt ttaaaaaaca
39181  gacaaaacac ttgattacaa tgRcccagaa gctactttc cttcaYtcac ttgccttata
39241  acagaaccat gctaaaattc ttctaggcta ataagatttt gttctatttt tagaccttcc
39301  ctaaagaaaa gtttatattt ctcaacagac catagtacta gtcctcaata taaaaaaat
39361  tgagatcaaa tcaacctttt tatttttcat gaaataccat agaatgtctt tatatattgc
39421  tgtgtgccct atacttaaac gattttaagc ttttggttt gtttgtttat ttgttttaac
39481  ctgcagaagc tgccatgact gtagaggtag gtcaccttga atccctgaat ggcccttggt
39541  tagtcctctc tagcagaaat gatgcaatag ggccttcagt ctgacttata gagccagcat
39601  ttctcttccc atgtggagtt caaatgtgga aaaggaggga tttcacaaa cctgcgtgcc
39661  tactggaaag tggaatctca aataaattct ctgacctctt cttcctgata tttaggcttt
39721  gggagatcta ccatgcggc tagggtagct ccaattcagg ccaagtgata tggaaagaaa
39781  aaaaaaggc tcttggaaaa ataaatcacc atgaggtaga gaaagaggag gctgaggggc
39841  tacactggct ggcaccggtt taagcgcaaa gaagagctat caagttttg ctaccccgtc
39901  caatactcca aaagcaatag ttttgtgaa aaactaaaag agtcactcaa taagagtgat
39961  gcaaccctt taggacacag accttcaaa aatggctatt atagtaagga aagctctgga
40021  caagattttc agagacagct tctggcttct gtgagagctt tttggctcat gaacagcacc
40081  ctcggctaa agtgacctt ctctaattca tgcagaatct gtggtagctt gaatcatgac
40141  agacacaaat attcatccta gccctggcat gctggggcct cacatcctgc aaagtatctg
40201  gctatgaaaa tagaagactt tgcctggctg tggtgaagta acttagcata atactgaagt
40261  attgagaaat aactactcac ggagccagac attcttttag cacgtttgac tgatactggg
40321  gcagaaggct gtaaacctca cctactgcaa ttcagatgtg gctggctgag cagctctcag
40381  cagccgtcag cactgacaac taagcaaaat gagactctca caccacccca gacaatagta
40441  agaacacaac acattgaacg tatataaggt gacaggactg ggatagtcag gcactgctct
40501  caggacctga ctgaggtaga accttccacc tctataaagg actctcaaat aatagaaaca
40561  ttctgactta gtgagtgaat gagtaaaatg aagttatttt tgaaaaattg tgaaaccatt
40621  acctaaggaa gctaccacaa agccaaactc tggttttgta aagacgcttt gccaagtggt
40681  aaatttccgg ctttgcctct tcctgagcat gtataatgct gtggttaggc cgctatccaa
40741  gcgaccttgt ccaggacccc tgcaggacac agtgtacata agctctcaga gcccccagag
40801  ccctctgagc tgttggcacc tccttcttct ctaacaata gatccagctc atgatcctgc
40861  ctggctggct tctccatgca gtggatttt ccattcaagt tttaaaattg aacatggctc
40921  aagagtacag ttcctgccaa agttcataaa tgccatttc tttttgcaac aaagctattt
40981  tcaggaggtt tccctaggag cctcagtgta cagctgttgc tgatatataa agcacaaagt
41041  acatagacac taatcacaaa caaactacaa gagagaatgc aaagtgctga gttcaagatt
41101  tttcctttca acaaaccaag agggctgctt taaaccactt gatttaYagt atttgttcga
41161  cggcctctgc aaatttacta catattcaga ttttgattg tttgttttt gaagaggaaa
41221  tgcgaatgtc acctccagtg aaagggcaca ttcacataca gatgtcttct atgtgacaat
41281  ataaaagaat aattgaccaa taatccagag agagcaatgt tacaacacac acgtataagt
41341  gctgggcagc aatcatcagg atgagatagt tcaaaacatt ccctgcctcc ttccgctaag
```

FIGURE 2-L

```
41401  gagaagttgg tatttgagca ctcgcttgtg ctctttccct atcttattta ataggaatta
41461  ttcttttgct aagtgacaat ctaaataaaa aataaatgag gagtggggat aaagaaaaat
41521  gccccagagg tgtctgttga gagagtattt taggagagtt tagcagataa gagtaattga
41581  gatgtgagaa atgaaggata agaggacatt aaagatagta tatgaacagt tatcagggcc
41641  tgtgactttc acccttttgaa tattttttca aaagactgta aacttcttc atattatttt
41701  ggaagatttg aacttccttg gttgaaatta ttgcagaaat tcaaacacaa atttatatgg
41761  attgcataaa caataactta aaatggatta gacacatttt tattgatggt taatttcata
41821  tgaatttata ttggtggtca attatatgaa ttttatactg atgaaacatg tccaaattgt
41881  ttcaattaaa tgaggaaaaa aacacaaaca agtacatggt cactgtgaat taataaatac
41941  tagaatttat ttatttcttt attaaatgta ttcattcagt aaaggtcttg ggcacctaac
42001  acatggcaga ctatataaaa aactgagatt tcaaaattga ataaggtgac tgctgaccac
42061  aaggagttca caatttactg gggtaagact gatgcaaaac agatcattag tatacaacat
42121  gataaatgat agaaacctgt atatggtcta agggaacagg gtggagaagt cctaacaaag
42181  cctagatttg atttcctgga gtaaagtgat gcttattcag tgagcgaaag atgtgtggga
42241  ggttgtcaag ataaaagaag gaggaaaaaa gtgactccat gccaagagca cattataagc
42301  caagttacag tatgtagaaa acagaatagg ggtggtggtg gtggtggtgg tagtggtagt
42361  ggtggtgcat gtgtttctct gtgtgtacat gcatgccaag aaaacaagaa ggaattttgt
42421  cacagtaaaa taaaacatgt cgtcagaagt gacaagatat aagagctgta cttagagaag
42481  cagaagggtc agacaaaggg tggatcaagg atgatccagg gggccaggcg ctgtggctca
42541  tgcctgtaat cccagaactc tgggaggccg aggtgggtgg attatttgaa gtcaggagtt
42601  caagaccagc ctggccaaca tggtgaaacc ccacctctac taaaaataca aaaattagcc
42661  gggcatggtg gcaggcacct gtaatcccag ctactcggga ggctgaggca ggagaatcgc
42721  ttgaacccgg gaggtggagg ttgcagtgag cccagattgt gccactgcac tccagcctgg
42781  gtgatagagt gagactctgt ctcaaaaaaa aaaaaaaaaa aaaaaaaatg atccagggta
42841  tcatgatacg gaagaaagaa gaagagaaac cactgaggaa tgtaagagaa cggaacagtg
42901  aaatttacag ctggattgaa gaaagatgta actgtaagca gagagaagag gtagggagcc
42961  attgcacgat ctataaaaaa atattgaaag ttctgactgc ggttaaaaaa aaaaaaagat
43021  gagggtgaac gaaagacaca gattcaggaa taattaataa atgttaataa ataaacttgg
43081  tagaagttgg ttttttgattg aacatatgtg atgggagaga agaatatgag tccccaattt
43141  ctaagctgag tacctgggaa gatgatcgtg ttggtgaagc catctaaaga aatagagaat
43201  ggaaaagggg aaatgagatt ggtagaggtg agcctaagtg ttatgtgaga agagatgatg
43261  atttgaaagt taagtatata atctgaagtt cagaggaatg ctgttggcta gagatgtgta
43321  tagatttgag actaacagca agtgatgttt gttgaaacta tgacagtgga tgaggtcacc
43381  cagggaagat atgtgggtat agagagtaaa tggccaaatt aaaatttaaa gattggacag
43441  aggaaggtaa gttcactaag gcaaaagaga atagctaaag aaatacatga aaaatgagaa
43501  tattgcaatg ttatagaagt caagcaagta gaatttcaca aaaaagctagt aattggccat
43561  ttcttgcaaa tgaagcacat gaggattttg actcgcaggg caccagaaag gcatgataga
43621  aagcatgcct ctgaacccctt tgaaagctttt ccaaacttta aattgctatc accccccagaa
43681  agatccagat agatcttcgg tggaggacgt taatatgaga catcacctaa acaattgaat
43741  aaaatgtaga aaagatcct caacaccaat ataattaaaa ggaaagaaac catagaacaa
43801  ttgtgacact agaaaaacta taatgatctc agatctactc tctcaagtct ctgagaactt
43861  gataaaaaaa aaaacactgt tctctatcta gttaaaggaa gtcacttttt ttctgagaaa
43921  ccaccatatg ttaagctgtc tttatataga ccttaataat cctcacagtc aggaaactaa
43981  gattcaagga aattttaaaa aatatatcat gaagtcatat agctaattaa tgatgaaact
44041  tttattaaaa cccaatttaa agagtaatcc agagcaagtg tcaatactgt tgaatctaaa
44101  ataaagacta ataaacaat atttaaagtg aacatctttg taaaacaaga aatagaaaca
44161  taagccaata gggtgaccat atttcccagt ttgtacaaaa tagttccatt ttatgcttat
44221  tgtccttgta attattagta gcacttacgc ccttcgctcc tttaagtgtt gtggtttgga
44281  gaataaatat gtggacactc tacatagcaa tgttgtgaca tggcatgtta gagatctaag
44341  gtatacagta atttgaggac aaagaaaaca actgaattgc aatgttttc taccactgag
44401  gtttcaacaa ttgcagctgt acctttttcct tctctgagac agcacgtcag catttccttc
44461  catttctct attttttagaa acgtaaaatt cagctataaa atatggctgt tggcagacag
44521  tacagacaag agtagaattc tgcataataa atctatagtt gaaaaatatg gattctgtgg
44581  gcattctatg gagttcttgc tgttggccat gactttctac taaagcgatc tctttaacaa
44641  gtacctgttc aattccctaat tgagctttcg aagtaaaaag ttgctctttc tgcctgtaat
44701  cccaggcctt tgggaggccg aggtgggcag atcacgaggt caggagatcg agaccatcct
44761  ggctaacaca gtgaaacccc atctctacta aaagtataaa aaattagccg ggcattgtgg
44821  caggtgcctg tgttcccagc tactcgggag gctgaggcag gagaatggca taaacttggg
44881  aggtggagct tgcagtgagc caagatcaca ccactgcatt ccagcctggg tgactgagcg
44941  agactccgtc taaaaaaaaa aaaagttgc ccttttcttgt gacttcattc attttatccc
45001  atatatataa gtaatattca ttgagtaaaa tggttttctt ttttttttac tgaatctttg
45061  agataatttt caaagataca tgggaagtat cttttttcaac agcattatag gatattagtg
45121  gtaaaagaaa gttcagagat tatctaatgc cacccttatt caattttcaa atgagaatat
```

FIGURE 2-M

```
45181  agaaactgag aaagcataag tgatttgccc acaatcacag agttaattag tgacagatga
45241  atacatttat ggtctcttat gggaaaagac agaataatgg aattcttatg gttgaagaaa
45301  cattaaactg gataatttga cacctgtaaa agatattcat taaagacaaa tttgtgcctg
45361  ccacacactg atttctgttc caattttctg tcagtctaca cttacagcta gagctggcaa
45421  ctatcataca agcagtcaac acttacattc ttaaacactt ttttgtcaaa gtatcatgga
45481  catcaaagac ctctaaacac atgaatctct aaagagataa aaaccagata tgagaaatct
45541  aagttgtaca aagttgttcc tttgattctt ctttgagccc tgaactgaca ttttttccta
45601  acacttatgc tctgaaccat atgacagtcc atcaagttgt tggtgtttgt ctgctttgtc
45661  ctaattaagg atctccctgt gttctgctgc cttgtttaaa atgtcaacaa aagctttaaa
45721  tagcactgta tctcagtgtg tgcactcatt attaattcaa catctggatc aaagtaaatg
45781  atattatatc ttactgaaat atgctttgtt ttttcttatt aagcttggca gttagatgat
45841  tgtcaaaaga tgcatgcttt attaaaacgc tttaagcaag aagggtatat cttagtacaa
45901  aattagatag aacaggaaat ccattaagga aatatacaac attttgattt tatatttcct
45961  tgaatctcta cacatagagt tttctaattt ttttttttctt aatttgatga ctaggacttg
46021  ttaaattttc accaattaat tagaaaataa aaatttttggt aaaatgactc tgatgaagca
46081  caaaatgata tgcacttttta ttgtttattt tggctaatgg cacagtttag catgtccaat
46141  ttttctctaa agccttatat tctctgtggc accaaSagca gttcattacc ccaaaatgga
46201  gctcagtatt tgtttcacaa atagtcttac caacaatcgc caaaataatg aaaatattat
46261  tgcaatatgc acaattatca aaagaattga ttagatataa ttaattccta tgatttctca
46321  gtaatgtgac cttactatgc attaagcaat gacctggttt ccaattacca aaaacttcat
46381  tgccttctga atgtagatat atggcatttt gtgatgtact atccgttgat tattaaaaat
46441  tgcttcagca agtttcagga actatgtctg tgttctcaaa cagaaattaa ataatatact
46501  actacagatt aaataaatgc cttttaaaag tatgatttga ggagatgtca gcaagatgat
46561  aaaataaggc tctccagtgc tccctctctc acagaaacat caatttgaac aactatccgc
46621  acacaaaaat accttacaaa aagtgaagga accaggtga gagatttcag cacctggta
46681  tagcacggaa acaagaaaag atgcactgga gagagaggaa ggacagtttc acattacctg
46741  cttcactttt cccccaatta ccagacagca cagcatggag acagataccc tccacatgat
46801  ggtaggagaa ggaagtgagc atcagactt gccttagacc ccaacactgg gcctgccaca
46861  gaaaaaccca gcaccaaaga gaccctcaca gccctagaca ccaggctagt acttgtggac
46921  tgagcttcca cacctttccc agcactgatc aggggcttat agccttagac tcaaggtcta
46981  tacagcagac ttggtctctg ggccactcta ctgccaggtc taccttagca gcccagcctc
47041  tggaacttct ccagcactgg gctgtcccct ataatcctgg acatcagatc catcccagta
47101  actgactatt tcctgcagac tcagactcaa agccaatccc agagccaagt agcccctgt
47161  ggacccaagg ataaggccag cctctacaga tgtaggcaaa tatttgcaga cataggcgtc
47221  aggtctgccc ttgtgtaccc aggtttcagg cctatccatg gggactcaat caataggtcc
47281  acacttgtgg atctagactt aggcccaacc ctatagaccc acccacctgc tgacccaggc
47341  acccagacac caagcccagc caacctacct gaggactcca acagcaggcc tacccttaga
47401  cgacaccaaa tggcatgcac aggttctatg gaaaggctga ctgataaaga gttttcccag
47461  acaaagccag tctgcaaaga ctggaataag cccttacttc ttcagatgca cagacatcag
47521  tgtaaggaaa taagaaacat gaaaagctga ggtgacataa accaccaaaa aaatacaaaa
47581  atctcccagt ggctgagtca agagaagtgg aaatatataa actaagagac aaaaaagtca
47641  aaataattgt tttaaggaag ctcaacaaac ttcaaaaaaa ttacagggaa acaatttcat
47701  aaaatcaaga aaacaataaa taaaacaaat ttaatagaga gattgaaatt attttttcaaa
47761  gacaaagaga aatcctattg ccgaatataa tgaatgaatg aaaaatgcaa tagtaggatt
47821  gatgaaggag aagaaagaat ttgtagcctt gaagacaagt tatttaaaaa tatatggtca
47881  gaagagaaaa aatgaaaaca aatagagaaa gtttatgtga tttatgggag agcatcaaaa
47941  gagcacattt tttagttcaa gaagagaaag acaaaggggt aggaagtatg tttaaggaaa
48001  taataacaga aatgttttca tatcttggga aagacatatt cacgtagagg aaagttaaag
48061  ttctctaatc agattcaatt caaacaagat tacaccaaga tatatcataa tgaaatcaac
48121  aaaaatcaaa gacaaagaaa ggatcctaaa ggcaccaaga gaaaagaagc aaataacatt
48181  taagggaatg ttcctatcaa gctagcagat ttttcggcag aaaccttaca ggccaggagt
48241  gtatgggaca acataatcaa aatgttaaaa taaataaaa aaactatcaa ttaggaatac
48301  tgtaccccac aaagttgtcc ttcagaaaag gagagataaa gtctttccac aacaaaagtt
48361  gagggagttc accaccagac ctgtctcaca agaagatgct taagagagtt cttcaggcta
48421  aaagaaaagc attctaatta gtgacacaaa aacatgtgaa agtgtaaaac tcacttacaa
48481  agataagtac acagtcaaac tcacaacacc ctaatactgt aatggtggta tgtaattcac
48541  ctatatctttt accatgaagg tgaaaagaaa aaaactacta agaataacaa tagctacaat
48601  aatgtgttaa ggcatctaca accacctgat cttcgacaaa cctgacaaaa acaagcaatg
48661  gggaaaagat tccctatttta ataaatgatg ctgggaaaac tgcctagcca tatgcagaaa
48721  actgaaacca gactcgttcc ttacacctta tacaaaaatt aactcaagat cgattaaaga
48781  cttaaatgta aaacccaaaa ccataaaaac cctagaagaa aacctaggca ataccattca
48841  ggacataggc atgggcaaag acctcattac taaaacacca aaagcaattg caacaaaaga
48901  aaaattgaca attgggatct aattaaacta aagagcttct gcacagcaaa agaaactatc
```

FIGURE 2-N

```
48961  atcagactga acaggcaacc tacagaaagg gagaaaattt ttgcaatcta ctcatttgac
49021  aaaggtctaa tatccagaat ctaccaaatt tacaagaaaa aaacaaacaa ccccatcaaa
49081  aagtgggcga aggacatgaa cagacacttc tcaaaagaag acatttatgt ggccaacaaa
49141  catgtgaaaa aaagctcatc atcactggtc attggagaag tgcaaatcaa aaccacagtg
49201  agataccatc tcatgccagt tacaatggtg attattaaaa aggaaacaac agatgctggc
49261  gaggctgtgg agaaacagga acgcttttac actgttgctg ggagtgtaaa ttagttcagc
49321  aattgtggaa gacaatgtag tgattcctca aagatctaga accagaaata ccatttgacc
49381  cggcaatccc attactgggt atatatccga aggattctaa attattctgt tctaaagaca
49441  catgcacaca tatgtttatt gcagcactat atacaatagc aaatacttgg aaccaaccca
49501  aatgccatc aatgatagac tggataaaga aatgtggca catatacacc ttggaatact
49561  atgcagcaat aaaaaagaat gagttcatgt cctttgcagg gatatggatg aagctagaag
49621  ccatcatcct cagcaaacta acaactagca caggaacaaa aaaccaaaca ctgcgtgttc
49681  tcactcataa gtgagagttg aacaatgaga acacatggac acagggagga gaacatcaca
49741  caccaggacc tgtcagaggg ttgggggcaa gggaagggag agcattagga ccatacctaa
49801  tgcatgctgg gcttaaaacc tagaagctgg gttgataggt gcagcaaacc accatggcac
49861  atatttacct atgtaacaaa cctgcacgtt ctgcacatgt atcccagaac ttaaagtaaa
49921  attttaaaaa aaagtgttaa gggatacaca atataaaaat atgttaattg tgacatcaaa
49981  aatttttaaat gtgggaggaa tggtgggagta aaagtatagt tttttaaaaa tgcaagcaaa
50041  aagttgttat cagcttaaag tagcttgtta taactataag atgtttttgt aattctcatg
50101  gtaaccacaa agtaaaaatt tatggtagag acaaaaaaga tacaaagtag ggaatcaaag
50161  cataccacca gagaaaatta ttttatcaga aaaaaaagac aaaaaaagag gggaagaaat
50221  gaacaaagaa cctacaaaac aaccagaaaa caatgagcta aatggcagta ttaagtcctt
50281  acctattaat aattaccttg aatgcaaatt gattaaattt tccagtcacc ttggatgtga
50341  aggggggctga gggaatagaa agaaaagact ccaaggtatc tcattatcca gatgaaaacc
50401  tggatagaaa gtagtgccat gaattggaag gaggaagcat agatttggtg tRgagaggag
50461  atatggccag tttaatattt aatatgttga ttttgcaatg ccaatttcaa ttccagtgac
50521  tgttagattt atacatctgg aactcaggcc agctctatgg gacgatgtgt agaattgagc
50581  catttatgat aattaaaatt aaggctgtgg tggaagataa gactcccaga gagaaaagaa
50641  ataagggcta taaagaaaaa atttctgaga tgcacaattc taagggaaga gagaacaacc
50701  cacattgagc aatggaggct gcaggagaac aggtgtgctg ccaccacaga aattaacatg
50761  caggggtgca gaaaggaagg tgttgtcagc ttattcaaat gggcaaatac atgagatacc
50821  catttttttg gacttggcac ctaagaggcc actggtgaat ttagagaaag cagtgtcaat
50881  gtttaaaaag tgaactggag taattgtgag taaacaagga ctaatgtttt atagagactt
50941  ggctataaag ctataagtca tacttccatt gctaaaggta gaagtgtagt taaaaataaa
51001  ggtttgcttt gattcttgt tctttgaaat gaaagagact agaacatgtt tatttgtaag
51061  aagtaattgc cactggaaac tgaaacatag gacacacaca gagaaggaag agacccacat
51121  gcagaaaaca aaggctataa ataaaagagt acagtgtcct gggttttcct ggatcttgtg
51181  taaatgactc catcacagca ttatcatgtt ttcttctcaa catcttcatc attctactac
51241  cattcgtaga aagtggattt tcatatatta tctcatttag tctttgtgac aaacctccta
51301  ttccaagtat gcaactgagg cacacaaaga tttaaaaatc tatgagttag tagcagaggc
51361  catatttaaa cccaaatcta actgaataca atgtctgtgt tctttgcatt tttccacccc
51421  aggcttatag ttcctactaa ttcaacctat tgaaatatat tttaacgttt tattaggcaa
51481  acaaagcaac agagaacagc agggaaaaag gcgactttat ctctagctga cggggctctt
51541  gaaatgctgt taatcaggat tctagataca aatttccacg tccactcaga ggggcgagaa
51601  tgtgcaatat attgtgatgc tgccaccttg tggcaagaaa aaatgaaaac attaagaggt
51661  gctttgtgtg catatttatc attttcaatt aaattgctct agtttatggt tcagctacgg
51721  ctgcacattg aaatcatctg ggagttttaa aaatactgct gcctagatcc cacctcagag
51781  attctgattt aattgttctg gggtgaggcc ttggtgtcag gatatttta aacttcccaa
51841  atgattctaa catgcagcaa agattaagac ctctgctcta accacttata cagtagagaa
51901  gcaagtcttg tcatttgcct agttatgttt catttgtata gacgcaaaag aaaacattct
51961  agagaaagta ggtgattttc tctcaatctt taatggcatc tagttcttgg tagaatacaa
52021  tgatttctgg acagatatat catatactat gattttaaag aacaggacaa agaaatttgt
52081  gaattgtaat caaagtggac acaagatttg tgtctcataa tcaaatgcag tccgtagact
52141  aaagtgagca gggagaatct ctgagcctca taatgcgtca caggtttttct gaaaggaaca
52201  atggaaagag cactgaagca ccattgactc tggcactagt aagatgagtg accttgagca
52261  agtcactcag tttgcaatga aagttttca tctactgctt tattcaagag aaactagttc
52321  caaatgttca acaaatatca taccaggtaa ttcaacaaaa ctttcttaag tacttgcaat
52381  gcgaaaagca tggaattata atgtgttata aatggaaagc actaatgttg cttagagaca
52441  tcatagcatt aggtgaccag aggaacctt gaaagctagt aatgcaaatt ttaattatga
52501  tctgaactga gtgtaattag aaagcttaat tacataatgc tccagtggtt tggcaaagaa
52561  gttgaattca gttttctcta ttttcattc tgttctgtag ttttctcaga tttatttatt
52621  agctctacac catcaaaaag tgtaatcatg tcttgaaaat gaaatttctc tttcctgctc
52681  cttggaaatt aaaattttct atggttcttt aactgaaaag tttcagtaat tgcaccacca
```

FIGURE 2-O

```
52741    atcacccagt gccttggtca ggaatctttc tttcttcatt cgttcattta acacatattt
52801    attaaccctc taccatatga tattactcat ctttgaattc cacctccctt aaattccaaa
52861    tttaattatt tacaattcat gtcaattatt agcttctaaa catctcttga atattctgYc
52921    catgtctaca gtgatttaga ttactacaga tctatcctcc tgccttctag ctccctttc
52981    tcaactccag tcccacactg cagacagtgg cccttgaaa cttcaaatct gctaatgcta
53041    ttgccccact tcctagtgaa tggcttccct tcaccctagg atagcatgca tggtacatga
53101    caatgcttgg gaactccttc cttatctggt ccctgcttac cagcccaaaa taatttctca
53161    cccttctcca ttaagtcact cagaaagctt aaagctttgc aattctctcc accctctctt
53221    gaccctggga ttttgcata taccctttct tctgcttgcc tttcttcact tggataattt
53281    cttttttagc ccttcatgtt cctgtttgaa aattaatcac tccaagcagc cttctgtaac
53341    ccacattact gggttatttt tatgtgtttc caatgtacaa taagcttaaa atttggaata
53401    cgtatcatca acatttactt atttatcttc tcactagacc atgggacaaa gaattgagaa
53461    taaaagacct aggaatccaa cttacaaggg atgtgaagga cctcttcaag gagaactaca
53521    aaccactgct ctctatttgt ctgttattcg tgtataagaa tgcttgtgat ttttgtacat
53581    tgattttgta tcctgagact ttgctgaagt tgcttatcag cttaaggaga ttttggactg
53641    agatgatggg gttttctaaa tatgcaatca tgtcatctgc aaacagggac aatttgactt
53701    cctgtcttcc tatttgaata cgctttattt cttctcttg cctgactgcc ctggccagaa
53761    cttccaatac tatgttgaat aggagtggtg agagagggca tccttgtctt gtgctggttt
53821    tcaaagggaa tgtttccagc ttctgcccat tcagtatgat atttgctatg ggtttgtcat
53881    aaatagctgt tattattttg agattttggg ctgagacaat ggggtttct agatatacaa
53941    ttgaaaatct agaagaaatg gaagcacagt atatagtaca tagtagatat caacaagta
54001    tgaaccattg atgaagaaca attatttgca ttcaaaaatc tacgatatat taactcggaa
54061    aaattggtca ggtaaagaga tgaaataaat tatgacatgt ctgacattac tcaaataatt
54121    tttaaaaagt agattccagc ttttgatata cacatattag ccacacaatc atgggcaatg
54181    tgcttaacat ccattaacat cctgagcttt agtgtcttca attctaaaca cagatacatt
54241    cattcagcaa atattgatta tatgactact aagggccaga cagtgttcta ggtagttggg
54301    atacagcagt gccccaaaga gtcactgtct ctcttttac gcatcttaaa ttctagttga
54361    tgagacagat aataaaaaga gatatataat gtcaaacagt gacacataga gaaaaaagat
54421    taagaggcta gagtgtaaca gagtactatt ctatttttc tttttagttt ttttcttttt
54481    gttttgttt tacttttaa actattatta gtattatttt tacaaacact tgtaccaagg
54541    gctgactttc aatagatcac agcaaggatc ccctctgcta catatgaaac cctgacccag
54601    aagcaggtca tctacttatg ttttagtgcc aggttacaca cgaatgtgtg ttacatgacg
54661    ggcaagggg cggccgaaga gtactatttg agaaaggatg gtcataaaag gcttctttga
54721    gaaggtaaca tttgagcaga gatttgaatg aagtaaagga gggagcaatg tgaatatctg
54781    gaggaagaat gtcccaggca gaaggaaata caatgcaaag accctaaagg gggagcttgc
54841    ttggtgtggt aaggaaaccg caaggatgcc atatactggt gcagagtgga aaagggaagc
54901    ctaaaggtga tatcagaaaa gtaggcagga gccagactaa gtagagccat gttttccaaa
54961    ctgcagtcat gaaaacaaat tggtgtcatc actagcacct tttagtgtaa ctaagaagag
55021    taaaatgaga tagaaaatat cagtgtatgg ttttctttt gtgtgtgtgt acgtgtgtgt
55081    gtgcacgcac gtgcacttgt acacgcatgc tgggttgcaa tgtaaaacac ccttcttact
55141    atgggttatg ataaaatttg aaacaacact gtggtagggc cttgcaagcc atgataagta
55201    ctttgagttt tgttataaat atgataagaa gccattggaa gatgggaagg tgttagctga
55261    ggaattatgt gaatgtaacg tgttttacat tttaaaagga aaattctagg cattctgcag
55321    aatggaccac aagggacaag agtggtgctg agagataagt cccagaatat tacatggtcc
55381    agggtagaaa tgatgtttgc atagatgaaa ggatgagaag tgatctgagt caaggtatat
55441    ttagaaagta agttcagtta agagttgttg aggatagtca tcattttcta gagtttttat
55501    gaggcttaaa taagattgga tatcagaaag ggttttataa acactagaga agtgctcagc
55561    agagtacagc tgagttcaat tcaaagggca tttactgacc atacactatg cacctgccat
55621    tactctcact gttttctctg cactcggtag ataaaactga atttctgctc ccaaggaact
55681    ttacagcagt agagttgtgg aagatagaca taaaaatgaa tcactgcagc ataatgcaca
55741    atatgataat ggcatatgga aggttctaaa gaaaatgagt taacttaaaa ttctgagaag
55801    cagtagcttt tgttgcaagc ctttcttttc ataggtaaaa gatcacatta gccccaagga
55861    tattctgtag gacaaatatg agctaaaaat gaactagaaa atagctctag gtgaaaaaca
55921    catcgaacac agatattgct gagttagtct attaaagcca catgtcattt gcacttttgc
55981    cctacagtca caaaacaaaa gcaaatgaac aagggaaaga ggatcttcag ccctcctaca
56041    taagtaacat gaatcaataa ggagtcatcc tggagaccac agaaaaccac actcttccag
56101    ttagcatcaa tgaatagccc caggatacaa atccacagtg aatgaagaaa catagctaca
56161    gaattagaaa cattattaag gaaaattgat ttgagtatac ttcactaatg ttagagggat
56221    aatattatat tttaggttga aatgtaataa tttttttaat tccaaagtgt ctattaattt
56281    taaaatatac atactttttg ttacaaatat ttatttttcc ccttcatacc actaatctct
56341    gtgaaaaagt ttagaatgtg acataaaggt tctaggttaa tgaagtcttt caatcaagca
56401    taaagacttc tgctaatcta gtaaaaccg ccccttctac ctacatggat tcaatatatt
56461    tgttgcatta tataagaaag catttgtgta ccacatttac atatgagatg tttatcagaa
```

FIGURE 2-P

```
56521  agaaagtggt gctctgagga gagggagatg gggaacagaa tcacttgaga gtgaggattt
56581  atttccaatt aattaacatg cccacaagaa tctgccatac cccacatgaa gaatcattgc
56641  tttaatatag attgatgagt tgataacgtt aatgagttga tgactgtctc tcaggtatgt
56701  tggggaacaa aaaagtttga gaaacaaata cagtcataaa gaactatatt ctaataataa
56761  ggcgttacca ttgctcctac tttttaatgt attatataca ttattatata atacttttta
56821  atgtatttaa taaatatatc tcatagtgga ttttcttaaa acagagcttg cctttcatt
56881  aagtaattac tccaaggagt aattttaaaa gaaaataagt ctaactgagc ttttgtgtta
56941  acatgatagg aactgataac atttccattt ttcttatgtc acatagacta aaactgttca
57001  gtttaaaata gttcaattac ctccataagc tttaagaaaa ccttctttaa taacatccta
57061  tgttttcaaa gttaattggg tactttcaca tttttttcct ttaaaacatt attagacagg
57121  acatttcatg ggtaaagatt agtgatgcaa ttataccacc atctctgaat gtcattcttt
57181  cttcatctcc attgccattg aagtccattt tgtcatcttt tatttcaact acttcactag
57241  cttcctaaat catctttcta ctattttatc acttcatcag tcagaaagaa tgatctacct
57301  aaaacacgaa tcccattgtg ttactccctg attaaaatct gttccccaa gcctgcagct
57361  tgggtaccct ctgggaatga cttaaaaggt gtttcctgac caggaccctg cttacatttc
57421  cagctgcatt tctcaccatt cccttccctg ctcacagtga attaactcat agttccccag
57481  gtgtgtcctg gttcatcttc tctcctggcc attgagcagg ctgcttcctt tgcctaccag
57541  attctactct tccacctcca tttcacttgg taactcttgc ccatcctttt ggtcccattt
57601  gaggcttttc ttcctcctaa aaacctccta tgtctgctat aggatgagtt atgccttatt
57661  cctttgtgtt tctatggcac tagtactatg gttatagtat cttacttact tacatattaa
57721  ctctactaca aactactaaa taacagaaac tatgtctttt tatcattaga attagtcaat
57781  cttcaatggc agcgtacact tgaagcttaa caaaagttta agtgaatgaa tgtggtggac
57841  ctgtccaagg tatgatgaga ctttgagtcc atgtcctcta attgttgacc cacagtggtt
57901  tccactgtgc tctactgtct cccagtgcca tgaccttggt ctccacactc tgtaactctt
57961  ggtcctcctc ccattgtctg tctacagtcc tttgctttgg gaaagctaga ctaagtaagg
58021  caatatttta aattaactaa ttgcaagcca agttttttgc ctggatttga gcttagcctt
58081  ccattcttgg gggagctatt cattacttaa gaaaacctac ctgtgactat gcatgtaaga
58141  attctggcta ggaataaact attgttcatg attaaacagg aatggtgcaa gaggcatgag
58201  caggcctacc tcagaaaaag aagtggtaac agattgctgt actatgaaaa cagcattctg
58261  gcatatatgt cctgaaagaa agtcaccaaa agttctttac gctaacttag tcaaaaacaa
58321  cacataccctt aggtaagaaa ttttcagaaa aagtgcttga gggttagcta atttatctct
58381  cactttttac agaggaacat cgaaggaatt cagctttcaa aatgccaccta aagatagaaa
58441  tcagattctt cttggaatta gaaactgtgg ggagcatctt ttgattgttg attgaactca
58501  tgttgtttta catcattat attctctttc acaatatatt gtgggtcatt attctacaaa
58561  caaccctctg agtctcatat gaaacctgca gcaagttatg gaagtggctt ttatcattct
58621  tacaattgcc ctaccattag aaagggacat aataattta ttatagcaca tactcctgga
58681  aagaccataa acttttaata gacttgtaaa aagggagtgt aaccttttca atattctgtc
58741  tcatctattc taccttctcc tcacatataa cgaatgccct agggcctaag tcatggatct
58801  acacttggga agaaaatgtt gagattcagc ctttccctg aatctgaagg ttaccatgat
58861  ttagcaccca ggaatagttt ctgcctatcc ttttttctggt tcttttgcag ctctgcaact
58921  tccagacttg tggtctatgt agagttgtga tgacattccg acttcatgtc tatagctttc
58981  atttagggat ttttaaatgt cagcataaac atcctacagc gtttaaagtt gtcttcacat
59041  caccacacat attcatttc agcatcatta atgattacac tttctgatta ttttcctttc
59101  tctgctagac tgtcaaactt cttagtttac ttcctaatat tgatagcatc accagctcta
59161  agcatgactt ctcaaacaag atgtttggtt aattttctgt gtgttttgt tgttgttcat
59221  ttgatcgtct caacttttg ttgcaatgca caacataacc accttcttag atcatggaca
59281  aagaaacaaa caaaaatctt tggagacaaa catggcagag gaaaataaat atcgcaaagg
59341  aagtgagtgc ttccgaaaaa caaagtggaa acaaagtatg aggaacccct gaaagcctca
59401  cagcataaga aaagaactga ctacttgaag agtagacagt ggctattaat ttctatttct
59461  tgaaaaaaaa ataccatttt aaaattgtca gggaccacaa gaaactgttt ttataatgtt
59521  aatagttttt ttaaatcaca ataataaaaa ttgaaagcat aatattttac atttatcagt
59581  tacttctgcc tccaccactt tccttaaaaa aagtaggact tttacagatg aaagagcatt
59641  ttaatacaaa ttttaaaatt acccgaagac aataaattat ttcctaaaac gtgtattaaa
59701  tcttttttgtt atgtctataa atgataatct agtctaagag taacttatca gcattttgc
59761  agtcccctcc ccccatccac tgaaaacttt ctttactaga ctcatgattt tcaaattttt
59821  aagaattaaa tttggagtaa aggaactccg aagatctgaa aaagcctgtg aactggatgt
59881  ccagaaagat gtaaatacat aattattgat agaaaatttt gggatgtttt tcaaaagccc
59941  ccagaagttc ctctaaggaa cccttagggg tcataggaaa gctcagtgct gggtagtgag
60001  ctcctaagag cagagaaatg ccctcctgtg tgcatctcta gatctggtac agtttcagca
60061  ttcataggg tgctataaac atttgttacg ttgaatcatg gaggataagt atgtatatac
60121  tcgggtgttg ttgttgctgt tgtttgagat agagtcttcc tctgtcacct aggctggagt
60181  gctgtggtgc aatcttggtt cactgcaaac tccRctccc aggtttaagc cattctccca
60241  ccacagcctc ccaagtagct agtgtaagcc accatgcctg gctaattttt gtatctttag
```

FIGURE 2-Q

```
60301    tagagacggg atttcgctat gctgcccagg ctggtctcaa actcctgagt tcaagtgatc
60361    cacccgcctt ggcctcccaa agtgctagga ttacaggcct gagccactgt gcctggaggg
60421    tattttttt taaaaagaa gaatgtagta tttaaaagtt catcatgcaa ttaaacctca
60481    ttgattttga gagcaaagga gcaaagaaaa atctgcaaa tagcaaacct actacttaaa
60541    gtaaaccttt aggaacttaa gcagggctgc tcaccaaata attctgctgg gtacagaact
60601    gatgtggcct.ttaaattaca gagtttatgt ataataatta acatccaggc cttgcagaaa
60661    acaatattac ctctgcagag catatcattt tctttattga taaatgctct ttactgaaaa
60721    cacaatgata tgaggatggg taggagtgcc ttagagctct ccttgaacat gtatacacag
60781    tggttaagag gagattcttt gatgatggac aaaaattcaa gtctagtttg attgttttag
60841    caacattaca ggtaagcaaa caaggcagga atgcaaatta ccaaaagagt tatgcttcct
60901    agagattccc caattttgta gcctctactt atctcgaggc aaagctgtct gacagagatt
60961    ctgtcttctg acatactcct attcttttct ctttttatt cttcctctta gtataaaatt
61021    tggtaaattt tagttaacag aacatctcac aagttcccac cctgacttct ttgcttattt
61081    catagaagga atSctaaaaa agaaaaatat atatttttt ctcccacagt ttatggatta
61141    catcctatgc agatgacacg ttggataatc tcttttttc caggatgaaa catattaaga
61201    aaataaaata cactctcaca aatgcccact acctcaagat aaataggtag atctcacaat
61261    atctcagata tcacctagga gagaagaaat aaaatcaagt atttggaaga acctgacaga
61321    ataccttagc catacctcag cctttcagag agcaacaggc atgaaatgtt ttagaaaaat
61381    aatttctgtt cccttccccc ttttcataaa gtattctctc tcagtgatcc attcaaaaga
61441    ttaatagcac tcatggtcta aagtgttcaa gataaaacat gaaaacaaaa accaaagcat
61501    ggattctact agacaacaaa acatgtctct cctaagaatg aacaattcaa ccattccagc
61561    ttttcacacc tgagaatctt ggattcagtg gattctgaat atcccaatga attaaaatta
61621    agatgaacct ttctcttcag gaatagaact tgctaaaatt agagataaat gagttacata
61681    ttttcagtga aatacatatt cctattataa gtcatatagg gagtgaggct cctaaaagca
61741    ggtggctaac tctatctaca acaaacattt tgacaagctc ccaccaacat aatacatggc
61801    atcaaaacaa tccgaaggca attcaaacga tagcttcacg ttaagcagct gaggcactgg
61861    gcaagcaaaa tctaatgaag ctatatttc tctggaaggc aattagtaaa ctgctcatat
61921    tttgctgctg aaagaataca tcagcatgaa cagatggaaa tttagaactc cacaaatgga
61981    attacagaca ttgatttaac tttccccaag caaatgaaaa ccacaaaata cgaattgctc
62041    tttctataat taagcacata attagagtgc atcagattca tatccattgt agctcatatt
62101    tcttcctcct catttctaaa tttatatata ttctgagtct aacaaaccta cttagagttc
62161    aactccacac tgaaagagtc ttctatgaca gatagatggt actaaactat ttctcaaatt
62221    aagcctgcca tgggtcacac tagctttttc acagcatgac acatgcggca ataataagaa
62281    atccaaagac tcaaagaggt agtccttgtg gcaggacaga tggagagaac agctgaggga
62341    ggaattcagc cagtttatta actccatgtg agtagaacaa atcatattta aaagaattca
62401    taaggacatc tggtcgaaaa acagaattta aatgatggca gttttagaat ggagaaaaga
62461    gaatcatgat gtctcacagt acaatatcac tgagttacct ctttgttttt ctacttccag
62521    gaaacaaaag gtcaccagtg acctgcacac agattataga ccaaactggt gRtgggcact
62581    tgggaaatac ttggactaat tgtcaagttt aaaatataca agaaatacta aaacatatta
62641    tggaaataaa atcactaaca tgctaaacat tacagatact tgaaattatt cacattgtta
62701    attattcttt tcctcattct aggatacagt agtttgtctt acttgtgaaa atatttaggg
62761    gaacttagat aaaattttg tttgatattc ctaaaatgct agaaatgacc tcagaaatct
62821    ttttgagaat aagcccttta taaaaacctc caaataggtc tttcctgaga aaactcaatt
62881    gatgtgcttt atcaagtata atagtatgtt tcatttataa gctttccaag ttgaaatcca
62941    aagtaataag catgtttcaa aaaaaatcta aacaagtaaa aatggggaaa cttactaaaa
63001    ctgtgcacac atatatagca tcaagaaata aactagcagt aaaatccaag gtcatattca
63061    gtgtgatagg cactgcagat cttttctatt aataaaaagc aacagaggct ttttctaccc
63121    atgaaatgtt tttttaaaag agcttctta ttattttagt gaaatgaagt ttttccttct
63181    taataaaaat tttcaaattt ctaccaaaaa aaatccttaa gtaactcaag ttttgcagtt
63241    tatgcttatt taaatatttg ataggtattt tctgccactt gagagttgct attaaatttt
63301    atataataaa cttcacttgc aaactgactt ccttctcaga caaatcaaat gacagcaaac
63361    aaaaataatg cctattaact attttaagta cattactgta ccctgtgggg aaaatcagga
63421    aacaaaaact gtagtttcag aatttcagat ggattagtta ttcagaaatt gtcttgagga
63481    catgccctaa ccttttgata tcactcatca aaggaaaatg tgactcacaa agactttaat
63541    ccccttttcct cccaacggga gatacagtct gtatagagag ctgtttgcat ttataactca
63601    Yttaaatcat gtcttccaga tacttcaggt ttaactcaca gtgctacact caaactaacc
63661    aatttaataa aaggattata aaatatttga agcaaactta tgcatatttt attcaatggt
63721    ttatctccaa acagtagata tctactgatg aactatttga acattagatg catcaaattc
63781    atattcattg tagctcatat ttttccttat cattcctaaa ttcatatata ctgagtctaa
63841    caaagtacat tgcttctagt tataatcaaa tatatttata agtctattct tcaccatgtt
63901    gtttcaggaa tttattatgg attcaagaga attcagtaaa agacaactgg ttaagccaca
63961    gttaataaag gtagaaacaa tgcaaacaag aactcattca tggagtagat ttaatagagc
64021    aagtaacaca ggatattcat aatcaaatga tattagcttt tacagtaaaa atgtatttga
```

FIGURE 2-R

```
64081   gagaattaaa agtcagtgat aataaggaat gagaataact ccttcccatc atcctcagtc
64141   atgtgaacta tgctcaaagg cttcagatgg tcaataaatt aatacatgaa tctttaaaat
64201   ataaattaaa tatttttatt tagttgctat agtaaataga aagatttaat ttatagttta
64261   aagattgtat acttttatgt ttagtatagc aactttagga ttctttggtt ttcagtaata
64321   atctatgcat ttgggtaacc aaacttagtc agcttggtca ggactttttt gtttatttat
64381   tttattttat tttattttat tttatttatt ttttttaaga cggtctcact ctgtctccca
64441   ggctggagtg cagtggtgcg atctcggctc actgcaactt ctgtctcccg ggttcaagcg
64501   attctcctgc ctcagccttc ccagtacctg gcactacagg tggctaattt ttgtattttt
64561   agtagagatg gggtttgcc gtgttggcca ggcccaaact cctgatatca agtgatccac
64621   ccgccttggc atcccaaagt gctgggatta caggtgtgag ccactgtgcc cagcaggaca
64681   ttatttata ttcagtcaaa taatagttta aaaatcatag ctaaaagtgg ataagcataa
64741   cttgttaatt atgattcaaa gcagttgatg cacatctggt tgaagattag cagattctca
64801   ctgcagttta gttataactg attaacattt caagggacat aggatttcag attctacagt
64861   caggaaacca tacaccaaac aagttaaata atcaagtaag gtagataatt catatttgga
64921   ggagtttatt ttgtttcttc aggagatgat aagttatcaa agattctcat tcaatagaaa
64981   ttgctattaa ctattagaaa cctaccaaga acaataaaag cagggacctg tttttttttc
65041   attttttgtt taaaaattca atgctgaatc actatcatct aggtcagtgt ggaacacaaa
65101   gtgtgggttc agtcaatatt tatagaataa gtgaataaat actaaactgt taacaaatag
65161   tcaaagctta tgtgaataac tctgttggat aaaaagaga aagggtaag aagtgaagaa
65221   gagataaaaa aggaagaaat aaaaaagagg tgagtgagag gaaagtgaaa agttctttcc
65281   tagtgaaaga ggtcttcct atggcagcag aagagtagat ttacagcaac ctaaaagaaa
65341   acagatggct gaatccttc aYtccccta cgtacatgtg gtccaacatt gtctcaacaa
65401   gactgtagcc ctacaaccaa caatcgaaag agtgacatca acacataaaa ggaaggaagt
65461   gcacattcag tggaaacccc aatgagaaat acgcttctgc caagactatc aggttggtat
65521   agtacttgcg atgtcttggc aagaaatcat gaaatacttg aagaaattaa ataattatta
65581   gggggatgct tacttcactt tactagggga ggtccttgag tacctcttct aacatctaaa
65641   gtcttctcct ctccagagga attgtgctcc gttccctggt tacttctcct ttacttaggg
65701   atttcagaat tgtgaataag gaaagaatga cctggtaagt gccagccctg gacacatttg
65761   cccacagatg ctgtcctccc cctttcttta gttgctcttt ttctcagggg gctggactct
65821   attaggccat atttcccaga tttgtctgtc agttgcctta ggKttggtct cagccaatag
65881   gagggagata tcaccaggag acagagggga gaatctaggc catttctccc caccccttttc
65941   tctagaagca gctgtatctt acctgtgtta gtgactctag ctcccattgg acaggccatt
66001   actacctggg ctccagtaaa tcgcccccta gctctcaggt tggtagtggc ttcccatttt
66061   tgcttatctc tgtgttggtc caagagtgtc tgcttttgac ttctgcattg caatatgaga
66121   acatccttat ctctgacacc tttaaatacc ccttagggtc tcatctactt agatctctga
66181   tcttagacca catgtctctc ctgactRccc agctggtctt gactgcttgg cctacatatc
66241   tgcatcagct gtctctctgg aatgcccaga tcaagctctg aacctgttc tactttgacc
66301   acaggcttct gattcccttc tctctttctt ctgatcccRt ctagctctat tccattcact
66361   tcatcatggt tgctggtcct atagctgctc aaagttgaaa agttgctact ctgaatgctg
66421   atgtttgctg aactgcagga caaaaccact ctataattat tctcaagttc ccacttcaga
66481   tttaccttga atagatttta ggcataatag gcatacacaa tatcaaagtt tacatatttg
66541   tgtcacaaga agattaaaaa taaagtatat ttcccacatg attggtcatc ccttccatgc
66601   atcctctttg gtaatatcca gtaagatata atggcagaca agaagatgga taaaataatg
66661   tcagatagta actctgctca cagggcatgg aatctatgat ggccttgtaa taaaatagct
66721   taatatagcc aggttaactt gtttctataa attctttcac cgtaggcaaa aataacataa
66781   tccctaaagt agtgaactag taaataataa taattaagca tttaagaccc tcttaatcac
66841   tttacattat aaacaaacag taaatgtgta atagtgttga ctattctggg ctcatgtttc
66901   ttaagtgttt attttaattg aacttcagca ctaatacatg taactgttac tctgtttccc
66961   aggttatact ctccctggga atctgaagat catgttgttt aattcaggat ctgtatcggt
67021   agattaaatt cccacccaac cctgtcccaa ttcccaaatt aatcttgagt taggtgaaaa
67081   aataacaagc aagctcagca ctggccctgt ttaccaaatc accttccagc caaattggtt
67141   gaattagtta cacctttct cttagtctag tggaggatgt cgtgtgtcct tagattccca
67201   aacaaaacat gcccgctctc tctctgtgct ctacattata gctggagtac aatttccagg
67261   cctcatttcc agcattctct tctggaactt tcatttggct gccacacaga aggccctatg
67321   tttcctgcca gctgtcctct gggttctcaa gtaccccagg ttcacctact agagaaaaga
67381   attccaaaat gccagctgcc caagcagctc tacctgcctc tctgccctga ttcccagagt
67441   aaggtttcag ccattaagaa ctgtctctgg gcatctctga aacacagcct tcaacacaat
67501   ggtctatctg gttgatcacc actggccatg aagcttggcc tcaacgcctg tcccatctta
67561   ggggatggtt ctaatctcag gtctagctcc ttcctttag tcaagaattg aggaatcatg
67621   aagtgttctc tgactccata tgtttgtact aggcttcttc atgatgattt atttgagttt
67681   tgatgtactt ggttttggct gaactcacat ctccctctcc tgctccctct ccctatgccc
67741   ttgcaaggaa caagaactac aaaatggagc cttttgtaag gccgttgcac tcaggagctt
67801   tcttgaagtg ctctgaaatt tctggcagaa ataaagctat ttaaaaaaaa tagttacagc
```

FIGURE 2-S

```
67861    ttatgttcct cttcttctgt gccctgagaa atagttaatc aactcttcct tagcttggag
67921    ttcacccaga tgctccttaa ggcttatctg tagctccact ctcagtggta aagccaccac
67981    tggatcctag cagggtgcct aaactcagta atgtggtaag agataaggca acaaagcttc
68041    atgaacattg tattttcttc caacagggca caaggaagat attaaactga gttccccca
68101    aaatcccaaa aatctcctac tgataatcaa gatttgtgga atctataatg tgtctttatt
68161    ttggtttaaa ctaatgacac tagattttct tctacctggc aagaagagg taggtataca
68221    ttaaacaaaa gaaatgaaa aaaatggacc taaaatcatg tgggaaatag atcattgtca
68281    tcattgttca aaaagaaat gttgtggaat atttctgcaa tttcctggcc agctagtctt
68341    tttcaccaga cgcatatatc tttttcaaat atcaaaagat agtaaagcta tgcatgtaaa
68401    agtcataata gtaatagtaa ttataagtat tataagggta agaataattt acatgattct
68461    tactgactcc caagcatttg ctaagcactt taactttca aaatctcaga atgctatgct
68521    gtacatatga taagaaagga gaactttctt agtttagaaa actgagttgc agaaaggtta
68581    agcaacttga tcaaagcaaa ttagtaatgg gaagagcaga aatttaaacc taactcatct
68641    ttcataccta tgaagatgca aataagtcaa ccaattacat ttgtgtgtaa tatatttgcc
68701    ctcttgatga atactgaacc agagttagag catcttctat ttgtttcatg aaaaagcatt
68761    gacattatac acgatttgtg tgttctactt tgaaatcaca ctttgttact ctaaacatta
68821    tttgaataag aagttgctaa taatttgagc agttatttca aatatttat gtactattac
68881    tacacagatg gattactctt gagcttggca tccaattttt aaaattttct aactcatgtg
68941    tacatgacta attttccctc tcagaattat gacaacattc attcatatgc tcttctctct
69001    tgattttgt acttggtag tttgggaaac atgataagat agctcgtagt ataactaata
69061    gcttagcaca catagcatat ctatactctt ttgacttttc ctctaaatat caccttatca
69121    tagtttgttc tttatcccct atccacttgc cattatttcc atccaatgaa acttattttt
69181    cttctctctc atctttgaat ttccttccct ccctaacagc atgtgagtta cttgaaagct
69241    ctttgatcag aataaaatc ccaattattt gatacttcca tttatttgga ttataaagac
69301    atacggggt atattttgca aaacagtctt gtcagccccg gcagaagata tatcactata
69361    ttatagcttt gccatgtgtc catagagaaa ggttatctta tgttaaacac atgttcatat
69421    gcaataacag agacatgaat tctaaggata ttgcagaaag catagctgac tactgattct
69481    agcaccttca ggatctttct cttcttagtt gYgaccactg taatgcactt catagagtaa
69541    taaattgttc ttgccctggg atcatgattc ccatctcttc actacaacat gtctagatgt
69601    aagacatgtt tacccttgta taatcaatga tctgagtcta gatgtcaagt acttgcttgt
69661    tctgtgcatt aactgtcttc ttttctgga actgcaggct ctatcagatc cttcccctaa
69721    aattcataca tcctgccttg ttactatccg tgccccagca tgaccaatat caaagtggtt
69781    aagaaaaagg ctccagctat tttagtatcc taaattttat cttttcattc tacaaagaag
69841    tttttcataa aaagttaaaa taaatttaaa aactcattga tactattcag taagatgtta
69901    tagattccaa gcaactatct cttttatagg caacataatt aaaagtgaat tacaaatgca
69961    gactttatga ctctaattaa actctaggcc acaatgcatt aaaaacagat tatacatatt
70021    aagttagata taagaaaaaa taaatatgcc acatagtgag gcataagtta atatgcctca
70081    aaataaatga ggagaaacaa tttcagataa tacatattta tataaaatgt ttatcaacat
70141    aacctaaaat attttcttga atttcatcag agataaaatt tttatactta attttgtaa
70201    acatatacat catactttct ctcacttact tcactacttc attccatccc aagaacatct
70261    gtgcaagtat ttcccaagtg tgggagactg gaagaggttc tatattttgg ttgtaagaat
70321    atatattaat ttttagaaca ttataattaa actcagaaat atttaattgt agggatatta
70381    tttggtaaga atcaaataaa atgactaaaa attaacttga ggcaacatga aatctcaaca
70441    tcattgtaaa actaagagag cagatcttaa acaaaatgta gtgcagtctt cacacttggg
70501    agattcatta atcacttaag tgttttctct gaagttttta aatgcttaaa gattgggtta
70561    cattatgaaa aggacctgtt taatattgtg tctgtaaagt tcaattctac ctagttctca
70621    cttcttcg tatcttctct agtgaagaat gaagaaatga gaattatgtg tttgaatcta
70681    gcacctctga catggaaaaa cacatggtga agcagaggaa agaaaactga aagaaagtga
70741    aaatatcttt aagaatacYt tgggaaaca aacagtattt caaatgaaag attaagaaca
70801    aatccaaaca aatggattgg aaggtattat gtaaaaaat atgagatgct ttagcacagg
70861    tactctaaga atttgagaag cttctcatgt ttaagggaga aggtaacatt cctgatagaa
70921    acatttaaag gcagtgcaga aaggaaattc tcatcaggag gcctatagaa cacacatggg
70981    caacagcaag ccccccttgc cctgctcagc cctggatcca tacagaggaa aggagagagg
71041    taaagatgaa agaaagaggt tgaacagaag atagtaaatg gttgaaaaat attttaaaa
71101    tagaaagagt tatgcttctg agaagattct ccatgtctgg gtatcagaca tggagataca
71161    tcatactgat caacctgaag taatgtactt actgaaatac ccacttctag ttcatcWagt
71221    tcatgcaagg tttcacaaag ccaccaatcg ttttaatcat cttataaaag ctttctaatt
71281    gaaatattct taagtatcac attttactag tggcaggtat cttttcaaaa aaaaaataca
71341    agctaagcaa cttgtcctct gttgttcct accactaagt ttgcattaga agagactggc
71401    agtcaaacac acaagaagaa acacaagtat tggcaattta acagaaacaa atggtagtgt
71461    atcatggaca tctaaggttt gtaggactaa atcatacct cttctagtaa gtcctgaaaa
71521    aaatgtattt aaaacatatg ttgaagaaaa tagcttttag aggggcagat aataggcttt
71581    ggacttagaa attttataaa aatccattgt gcattcttta ggcttctagt cctattcagt
```

FIGURE 2-T

```
71641  ttttgctatg agctatgatt tgtttgtgga agcaaagtaa aggcagccta tttcttaccg
71701  cctccacttc ggctgggtca taccagacgt tgatgtaggg atgctgtaag gcgtcgtcca
71761  ctgatattct ttttgctggg tcaatcacta gcatctttga caacaagtcc ctggcttggc
71821  tggctgaaac aataaatgag aaaaacaatt agtaagattt tgatttcagt aaggaaattt
71881  gtcagagagg aaatttaaga aaacaaagta tggaatagta tcttccttcc aaacatcagg
71941  taaatccctt gatgtgatgg aaaagaaaat gcatttaca cctgtttctt tgtgtctcta
72001  agcctaaggc ttcattctga ggctctccaa gggttgtaac actttgggta tataattatt
72061  cacgcaaact tcttagtaaa atgtatcaac ctggagagtt tatgtaagca aagtcatctt
72121  ctttggtaac ctgcatgaat ataggataaa cagaataaag agcacagagt gcaaatgcat
72181  gatgttcaac aaatgtgtgg acggctgttt gaagttaatc aacacgtgtg tctctatatt
72241  cttatttata caacggaatt atcagaattt tagtatataa attgacttaa gagtttgtat
72301  catacaaatt tttcttttct ttttgttttt gtttatttat ttatttattt attttgaga
72361  cagggtatcc ctctgttgcc aggctggagt gtagtggaat gatcacagct cactgcagcc
72421  tggaactcct gcgctcaaag gatcctccca tcccagcttc ccgagtaact ggaactacag
72481  gcatgcacca ccatgcctgg ctatttttc tttctttctt tttttttgta aagataagat
72541  ctccctacat tgcccaagct ggtctcgaac tctgggctca aagatcctcc cacctcagcc
72601  tcccaaaatg ctgggattaa aggagtgagc cactgctccc agccacaaat ttcttatata
72661  cataaaaaca atcaaagaat tgaagtgata gaaataatat cattcaacta ctgaatttta
72721  ttttaacatt ctgtaatcat caggtatttt taatcaatgg aatcatgact tgatgaaatc
72781  cagtagttaa agactgaagc cagtctaatg ctacaccaga cactaatgag aaactctata
72841  ttatgtaaag gttatcataa ttaatttat ggttgtgggc agtaacagtt ataaaattat
72901  atggtgatag ctatttattt agtaagattg ttaaaagaca cattaatttt aacctctaaa
72961  aatatgtaaa tttttaaat tattatactt taagttctgg gatacatgtg cacaacatgc
73021  aggtttgtta cataggtata cacatgccat agtggtttgc tgcacccacc aacctgtcat
73081  ctacattagg tatttctcct aaagctatcc ctccctagt cttttacata aagttttaac
73141  agaaatgaat atctcaaatc aatattgtta ctcaactgat ctgaaagttg aaccgtgaaa
73201  atattcagtt tattctaact atatgtaaa acatcaaatt aaagataaca aaatttaaat
73261  ggatttttca aaaaatcaac atagatgact ctggatacat atcaatttt atttaatcaa
73321  tttttcagat taaaacaact tggctaattc tacaaatttg aaaattatat aaaatacaaa
73381  aWtcaggaaa taatatctaa ccccactagc tagaggcaat gactgtgatt attggcatat
73441  tttttctagt gccgttcatg tatttttcac gtaatattaa ccatactata gttaaaatgt
73501  agcaattaat ttttttacctg taagtatttt cttggtaatt acatcaataa atatatcttt
73561  taattttctg aacaaatatg aaaaatcact agttaaactt gagaattttt tatttctatt
73621  aatcattttt ctgggaaact caatcctaga aactgattat cattactttc aaattaaaac
73681  tctgtaccgc acaggaataa caaaaataca gaaatactta tacattaatt caatatttaa
73741  ttttctcat tgccaatggc ctcctaatag cctaacaggg ctgtgtttat ttattcattg
73801  ctttaaagac ctctttaatt tgtaactgat tttacatcca aattcatgta ccattctcat
73861  aagattctct catcaaatct atccatttt ctgctcttag aaagggctgg ggttagccgg
73921  gcgtggtcgt ggctgacacc tgcaatccca gcactttgga aggccgaggc aggcagacca
73981  cgaagtcagg aggtcgagac gatcctggct accacggtga acccccatct ctactaaaaa
74041  tacaaaaatt agctgggcgt ggtggcgggc gcctgtagtc ccagctactc gggaggttga
74101  ggcaggagaa tggagtgaac ctgggagacg gagcttgcag tgagcctaga tcggtatccc
74161  gggcgacaga gcgagactct gtctcaaaaa aaaaaaaaaa aaaaaaaga aagggctggg
74221  gttacaatgg attcttcatg aatagggtca tgaactacac caatacaaaa tcatcttgct
74281  aagaaacaat actattttta ggaaacaata tgggaaaatg tttcaatgct ttatctttca
74341  ttctttcatt tgaaagcaaa tgtgttatgc tcttttccaa acacagtaga atacattctt
74401  ctcttggtt atttgtatat taagattatt tataatttgc cattttata ttaaaaatta
74461  aattcaataa tcaaatatgc aaactagttt atcatttaca aacataattg cagagattca
74521  aattgattta aaaagtaaac tcaagaaaat tggaattaca ttatgaagta taatatatat
74581  ctatttttg agacggagtc ttgctcactc tatctctagg ctggaatgca gttgcccgat
74641  ctcggctcac tgcaacctct tcctcctagg ttcaagcgac tctcctgcct cagcctcctg
74701  agtagctggg actagaggtg tgtgccacca tgcccagcta atttttttat atttttagga
74761  gagacgcagt ttcaccatgt tggccaggat ggtctgtctc gatttcctga cctcttgatc
74821  ctccccgcctc cgccttccaa agtgctgagg ttacagactt gagccaccgc cccccggccct
74881  gaatatccag acaattctaa aatccgtgac tactccctct tgtaggaacg atctttgaag
74941  aaatattct ttaacttgag gctgtgccaa ttaaagaatt gatcaatgtt ttaggtgatg
75001  ggttatgcta attgctctga tttgaccatt atacctctat acatgtttca aaaataccac
75061  cctatatccc acaaaaatgt acgattatca tgtgtcaact aaaaataaaa gggaacaaag
75121  agaaagagat agaggtctct atactgtgtg cttgtttggc ccgtcaccct catagttgtc
75181  ctcaagtcat tcctgaaggg cataccttg agtttattgt gctcggagtc cgctgggaag
75241  agggaatctg ggaagagttt ggggaaggtg agtcccgcat acttgggccg attctccaca
75301  tagtttctta ctgtgggttg caatttcttc atgaattctg gacatggtgt tcctagttgt
75361  tcaattacct tattccactg gtcaatatct gagaattgaa cagttaaggg aaaaagaag
```

FIGURE 2-U

```
75421   agcagaccac  tagcctttca  acaattggga  gactaactct  tctcaaagtc  ctcaacagtc
75481   attaatgcaa  ctgtagtttt  aataagcaac  aaagaatgaa  aatataaaat  cagacttgca
75541   ggctatgagt  cttcttgaaa  ttttaaattc  acttttgaaa  cttatatact  tttggaaaac
75601   tagcaattat  ttaacaaaat  aagatatcat  gaaatagtct  ttggggtgta  cagataaaaa
75661   gtcattcaga  taacacaaga  tgaatctcat  attctgcaga  taaacttcta  tataaatcat
75721   gtgattcaga  agaaaaatat  ataatgacac  atcatagtga  cattttatc   ctgaagttac
75781   ctcaattatt  tatattttta  aaatgacaaa  tacacaaata  ttttagatta  tattcattta
75841   cattttccta  aactatcttt  aagatatttt  ttcttctcta  aaaatctgga  attttttct
75901   attttatgc   atatcaacat  aacttttata  gtaaaacaac  tcattagttc  tttgtcagat
75961   tcctaaaaat  catatttatt  aaacaagaa   gccacctatt  tcatacctat  tgttttactg
76021   atgatatcac  tgaatattgt  tttcaatgaa  ataaagggt   gaacagagga  atattcaatt
76081   taaaacaaca  gatttctatc  caagtacatc  caagtttaga  aagtacatta  agcatgggga
76141   ataccacaga  aaaaatatta  cctctctatg  aaaattaata  ccctttaaa   ttggagctag
76201   ctcttttgc   agacatactc  aatgattgag  attctctttt  ttatctgtca  ttaatattcg
76261   atatatcaga  gccttgataa  tgataaacac  catctactct  gaagaaYcaa  ctggaaacaa
76321   ctgatttaaa  cagatttcct  cgccatgtgc  cagtgaataa  tagagatctt  ggaaattccc
76381   ttaaatccaa  tactgcaagc  agtattctct  cctacattgc  ttattcttct  acaactgttc
76441   tttggtgtta  agttagttaa  ctcatttcca  ctaaggtaag  gtgtgacagt  taagggactc
```

```
   1    gaagcgctga gggccactca ccggccaggg acgcgaagag cgcggccgcc gcgctgagct
  61    gccggggcat ggtgggcgct gggcgaggtt ctgcagcgtg cggcgaRgtc cgggcaggcc
 121    ccgaatcggt gccagagaaa cctacctgtg ccggagaaac gaaaccacct gcttatgaga
 181    agcagccgaa aagcccgccc agggccgctg ggcggggagg gaaactccgc cggcccctc
 241    ctacccctac ggagcaggga ggggcgggga ctcggcgcag ccgccggggc ccgggcctct
 301    gggaccgttt accgcacgcg cgtggtcccg gcagcgccgg cctcctccgc tcatacccctg
 361    ggtctcctcc tttcttttc ttttcttttt gagacgaagt ctcgctctgt cgcccagggt
 421    ggagtgcagt ggcgcgatct cggctcacta caacctctgc ctcccgggtt caagcgattc
 481    ttctgcctca gcctcccgag tagctgggat tacaggcatg caccaccaca cccggctaat
 541    ttttgtattt ttagtagaga cggggtgtca ccatattggc caggctggtc tcgagctcct
 601    gacctcgtga ttcgcccgcc tcgacctccc aaagtgctgg gattatagac gtgagccacc
 661    gagcccggcc agggtctcct cttttatttc ttttctttt atttcttttg ttttgttttg
 721    ttttgttttg tttttgaga caaagtctcg ctctgtcgcc aggctggagt gcagtggcgg
 781    gatctcggct cactgccctg gttcaagcga ttctcctgcc gcagcctccc gagtagctgg
 841    ggttacaggc gcccgccacc acgcccagct aattttgta ttttagtaga cacggggttt
 901    caccctgttg gccaggctgg tctcgatctc ctgaccttgt gatccgcccg cctcggcctc
 961    ccaaagtgtt gggattacag gcgtgagcca ctgcgcccgg cccagggtct cctcttttct
1021    aacagctcgg gtacctttct gggaacccag agacgcttct cagccgggag aaagccagcc
1081    actaggcgag caggagccta aaaaccccta agcacccctga ctccatgtct tcccagggag
1141    tctgcggcag ccgcgctcca cgcccaggcc tcgccaggac cgcggtttgc gggaagcaac
1201    aggagcacag cccagaggcg ctaggtctgg ctgggagctc gcgctgccga ctccccggcg
1261    tgcggcgtcg gggaacctct aggagccttg gattcttcag ctgtaaacg gacataataa
1321    tgcccactcc cagtgtgttt ttattttc ttttttcttt ttctttcttt gttttgttt
1381    gtttgttttt gttttgttt ttgagacagg gtctcactct gtcgcccagg ctggagggca
1441    atggcgtgat ctcggctcac tgcaaacttg ggttcaggcg attctcctgc ctcagcctcc
1501    acagtagctg ggattacaga tgtgcgccac cacgtccggc taattttttg tattttagt
1561    agagaccagg tttcaccgtg ttggccaagc tggtctcaaa ctcctgaccc caggtgatcc
1621    gcccgcctcg gccttccaaa gatctgggat tacaagcgtg agccactgtg cctgcccca
1681    ggtggtttta cagaccagaa aatcctggaa caaaaaacac acaatatcgt tttttttt
1741    tttttggagt cagggtctcg ctctatcacc caggctggag tgcagtggcg tgatctcggc
1801    tcactgcaac ttcgacctcc tggcctcaag tgagtctccc accttagcct cctgagtagc
1861    tgggaccaaa ggcgcgtgcc accacgccca gctatttat tttatttat gtagagagga
1921    ggtctcgctg tgttgcccag gctggtctcg agttcctggc ctcaaatgat cctcctgcgt
1981    tagccaacca ttgggattac aggcgtaagc cacggcccac ggctcaacaa cgctgacagg
2041    caacctttta atgtcttatc tccttcctct attaattgga ttgtctgtca aaacaacgat
2101    gttttgacag ggcttgagtc ccagtgggga atacacattt aagcagtata ttaggaSacc
2161    ctccttatca ctagattgag ggcttcagc ctagcctcaa attattttct gaaaaataac
2221    tttggctaca actattttgt cttactatgt tgctccaaac actaatcaag taaacttaac
2281    caaagcttgc agtgtgtttc agaatggaat ttttatggtg aaaagtgagg gttaacttgt
2341    gccagtcaac ctagtttcag caactacctg ctttctgatc tttgagacag tttattcaaa
2401    agacgataat taagtgggta tagactgtgt gccaggcact cttcttattc catttaagcg
2461    ccatagccac tctatatgga cactgttgtt attatcgctg ccccatttcg cagatggaga
2521    aactaagcac aaagaaggga gttcccaga gtcacttaga taataaatac cgaaacctga
2581    ccataaatct tgtctgcctt gagagtctag gatttttaagc acatagccgg gcgcagtggc
2641    tcacgcctgt aatcccagca ctttaggagg ccgaggcggg cggatcacga ggtcaggaga
2701    tggagaccat cctggctaac acagtgaaac ccagttctat taaaaatata aaaaaattag
2761    ccaggcgtgg tggcaggtgc atgtagtccc agctactcgg gaggctgagg caggagaatg
2821    gtgtgaaccc aggaggtgga gcttgcagtg agcggagatc gcgccactgc actccagccc
2881    gggcgacaga aggagactcc gtctcaaaaa aaaaaaaata aataaaataa agctgctcct
2941    cttacccctgg aaattccaag ggatttagga gctctgtttc aggaaccagg gtcaaagacc
3001    aagtattaaa acaaaagatt ctcctagaac tctggcatat aaggatttta ggagctctgt
3061    cttagaaact gggacagaga ccaaagatat attattatat cgcagtatca tagtttatta
3121    ttttcaaaaa acgttttctg gctggtacag tggttcatgc ctataatcca agcactttgg
3181    gaggccaagg tgggagggtc acttgaggcc agaagttcaa gtccagcctg gcaacacag
3241    ggagaccctg ccactattaa aattttta aattagctgg gcatggtggc acatgcctgt
3301    agtcccagct acttggagg ctgaagcagg aggattgctt gagcctgaga ggtcaagact
3361    gtagtgagct gcgatcaagc gactgcactc tagcctgggt gacaaagcca gaccctgtgt
3421    ctaaaaaaaa gaaaagaaga ggaaaaaaaa aggtttttat ttcaactaag ttgttggatt
3481    tattagcata aagcttttca taacaatccc ttgtcttaca atatctgtag tataggtagt
```

FIGURE 3-B

```
3541    gatgtcactt cttttattac taatattaat aatttgtatt ttctctctta-tttccctgct
3601    aatattaata atttgtattt tctctctttt ttccctgata agtttggctg gaggttgatc
3661    aattctattc atgttttcaa gaaaaaaaaa aaaatttcat ttcatcgagt tccttcattg
3721    ttcttatgtt ttctgttta ttcatttcta cctgatcttt attattttct ttcttctact
3781    taacttgtgt tttatttgct cctctttcaa tagttttcaa agatggaact tgcctgggat
3841    atcccagcac tttaggaggc tgaggtggga ggatcacctg aggtcaggag ttcaagacca
3901    gcctggccaa catggtgaaa ctccgtctct actaaaaata caaaaattag ctgggtgtgg
3961    tggtgggcac ctgtgatccc agctactcgg gaggctgagg caggagaatc gcttgaaccc
4021    gggaggtgga ggttacagtg agctgagatc acgcactgc actccagcct gggtgacagg
4081    agctagactc tgtctcaaaa aaaaaaaag aaaaaaaaaa agatggaagt tgaggccagt
4141    ggtataaaat ctttcttcat ctctaataaa caggtttact gttatgaacg tccctctaat
4201    tactacttta gttggatccc acaagtttaa tatgttttca ttttcatata attagaaaga
4261    cttcctaatt tccttttgct atctcctcga ctcatggtta tttaaaatag cattatttca
4321    tttccaaaca tatagttttt cagatatctt tcttttattg attttttaatt ccactgtggt
4381    tgaaaacata attatggact taaatcttac aaatttattg atattttgttt tttgaccaag
4441    actatggttg gttacattag ttttcaggac tgacataaca aagtgccaca gactgggtaa
4501    ttaaaccaca gacatttgct ttcttataat tctggaaacc agacatgtga gatcaaagtg
4561    tcagccgggt tggttttttc ttttccttt tttttttttt tttttgagac agagtctctt
4621    tctgtcaccc aggctgggat gcagtggtgt gatctcggct tactgcaaat tctgcctccc
4681    aggctcaagc gattctcctg cctcagcctc ccgagtagct gggattacag gtgcctctca
4741    ctgcacctgg ctaattttg tatttttagt agagacgggg tttcaccatg ttggccaggt
4801    tgatctcaaa ctcctgatct caggtaatac acccgcctcg gcctcccaaa gtactgagat
4861    tacaggcgtg agccactgca cccggcccgg gttagttctt tctaaggcct ctctccttgg
4921    ctagtagaca cctttgttc acatggtcat ccctctgtgc atgcctttgt ctgtcctaat
4981    ctcctcttct tataaggaca ttagtcagat aggattagtg cctactcttt gaactcgttt
5041    tacctcttaa agaccctatc tccgaatata gtcacattct gagatacttg gggttaagac
5101    ttgtattagt ccattttcac gctgctcata aagacatacc tgagactggg aagaaaaaga
5161    ggtttaattg gacaattcca catggctggg gaggcctcag aatcatggtg ggaggcgaaa
5221    gggacttttt acatggtggc ggcaagagaa aatgaggaag aagcaaaagc agaaaccct
5281    gatagataag cccaccagat atcatgagat ttattcactg tcatgagaac agcacgggaa
5341    agaccagccc ccatgaatac attacctctt ccttggtccc cccctcccca caatatgtgg
5401    ggattctggg agatacaatt aaaattgaga tttgagtggg gacacagcca aaccatatca
5461    ttctgtccct ggtccttcca aatctcatgt cctcacattt caaaaccaat catgcctttc
5521    caatagtccc tcaaagtctt aactcatttc agcattaacc taaaagtcca cagtccaaag
5581    tctcatctga gacaaggcct tccgcctatg agcctgtaca atcaaaagca agctagttag
5641    ttcctagata caatggggt acaggtattg ggtaaataaa gccattccaa atgggagaaa
5701    ttggccaaaa caaagggggtt acagggccca tgcaagtctg aaatccagtg agggagtcaa
5761    attttaaagc tccaaaatga tctcctttga ctccaggtct tacatccagg tcacgctaat
5821    gcaaaaggta ggtttccatg gtcttgggca gctccacccc tgtggctttg cagggtacag
5881    cctccctcca ggctgctttc atgggctggt gttgagtgtc tgcagctttt ccaggcaccc
5941    agtgcaagct gtcagtggat ctaccattct ggggtttgga ggacaaaggc cctcttctca
6001    cagctgcact aggcagtgcc ccgatagga ctctgtgtgg gggctctgat cccacatttc
6061    ccttctgcac tgccctaaga ggttctcctt gagggcccca cagcttccac cctctgaacc
6121    atagcccaag ctatgcattg gccccttca gccatggctg gagcagctgg gacagagggc
6181    accaagtcac taggctgcac acaacatggg gaccctgggc ctgccccaca aaacccctt
6241    ttcctcctgg gcctccaagc ctgtgatggg agaggctgct gtgaaggtct ctgacatggc
6301    cttggagaca tttccccatg gtcttgggga ttcacattgg gcttcttgct acttatgcaa
6361    atttctgcaa ccagcttgaa tttctcccca gaaaatgggt ttttctttc tgtcacatag
6421    tccggctgca aattttccaa acttttatgc tctgcttccc ttataaaact gaacgccttt
6481    aatagcaccc aaatcacctc ttgaatgttt tgctgcttag aaatttttc caccagatac
6541    cctaaataat ctctcaagtt caaagttcca caagtctcta gggcagggc aaaatgtggc
6601    cagtctcttt gctaaaacat aacaagaggc acctttgctc cagttcccaa aaagttcctc
6661    atctccatct gagaccacct cagcctggat cttattgtcc atatcactat cagcattttg
6721    ggcaaaacca ttcaacaagt ctctaggaag ttccaaactt tcccacattt tcctgtcttc
6781    ttctgagccc ttcaaactgt tccaatctct gcctgttacc cagttccaaa gttgttccac
6841    atttttcaggt atcttcagca acgttcact ctactggtag caatttactg tattagtcca
6901    ttttcacact gctgataaag acatatctga gactgggaag aaaaataggt ttaattggac
6961    ttacagttcc acatggctgg gaggcctca gaatcatggt gagaggtgaa aggcacttct
7021    tacgtggtag tgacaagaga aaatgaggaa gaagcaaaag cggaaacccc tgataaatcc
7081    atcagatctc atgagactta ttcactatca cgagaatagc atgggaaaga ccggccccca
7141    tgattcaatt acctccccct gggtccctcc cacaacacat gggaattctg ggagatacaa
7201    ttcaagttga gatttgggtg gggacacagc caaaccatat caagacttct acatatgaat
```

FIGURE 3-C

```
7261   tttggaggga cacaatttaa ctcataatag tggactgtcY tgttaaatgt tctgtgtgca
7321   cttgagaaga atgtgtgtat tctctcattg ttggattcag tgacctataa atgttaatta
7381   ggttaaacta attgatgtag ggaaaagaaa gagagatcag actgtcactg tgtctatgta
7441   gaaagggaag acataagaga ctccattttg aaaaagacct gtacttcaaa caattgcttt
7501   gctgagatgt taatttgtag ctttgcccca gccactttgc cccagccact ttgacccaac
7561   ttggagctca caaaaacatg tgttgtataa aatcaaggtt taagggatct agggcgtgtgc
7621   aggacgtgcc ttgttaacaa aatgtttaca agcagtatac ttggtcaaag tcatcgccat
7681   tctctagtct caataaacca ggggcacaat gcactgcgga aagctgcagg gagccctgcc
7741   cttggaagcg gggtattgtc caaggtttct ccccatgtga cagtctgaaa tatggcctcg
7801   taggatgaga aagacctgac tgtcccccag cccaacaccc ataaagggtc tgtgctgagg
7861   tggattggta aaagaggaaa gcctcttaca gttgagatag aggaaggcca ctgtctcctg
7921   cctgcccctg ggaactgaat gtcttggtgt aaacccgat tgtacatttg ttcaactctg
7981   aaataggaga aaagctgccc tgtggtggga ggtgagacat gtttgcagta atgctgcctt
8041   gttattcttt actccactga gatgtttggg tggagagaaa cataaatctg gcctatgtgc
8101   acatccaggc atagtacctt cccttgaact taattatgat acagattctt ttgctcacat
8161   gttttttgtt gaccttctcc ttattatcac cctgctgtcc tactacattc ctttttgctg
8221   aaataatgaa aaYaataatc aataaaaact gagggaactc agaggctgg gccggtacag
8281   gtccttggtg tgctgagtgc cggtcccctg gactcactgt tgtttcttta actttgtct
8341   ctgtgtctta tttcttttct ccggctctca tcccacccga ctagaaatac ccacaggtgt
8401   ggaggggcag gccacccctt caattgatga tatggttcaa gaacaaatgg tatcaactta
8461   ggatggttta acttatgatt tttcaacttt agaatggtgt gaagtctgta tgcattcagt
8521   agaaggcata ctttgaattt ttatcttttc ccaagctact gctatgggac aagatactct
8581   ctcacaattc tgggcagtgg cagcaagcct cagcttccag tcagcaccca atcccaaggg
8641   taaacaactg atacagccat tctgtttttc attttttagca aaatactcaa taaattacat
8701   gaggcactca atgctttatt ataagacaag ctttgtatta gatgatttgc ccaactgtag
8761   gctaatgtag gtgttctgag cacatttaag gtagactata ctatgccatg atgtttggaa
8821   ggttaggtaa atttaatgca ttttcgactt agaatacttt cagcctccca aatagctggg
8881   accacaggtg tgtggcacca tgtgtggcta atttttgtg gagacaaggt ctcactgtgt
8941   cgcccaagtt ggtctcaaaa tcctgacttc acgtgatcct tccactctgg tctcccaaag
9001   tgcgattaca ggtgtgagtc accacacctg gccgtgttgt cacacatttt aattctttat
9061   aaattagaaa cttcacaaca cattgttctt atttaaatt taaacaatta tctttaaata
9121   tacataatat ataaatatgt atatacatata taaatatata caatatataa atatataaga
9181   tatattatat atataatata taaatatata atataaaat atataatatg taaatatata
9241   atatataaat atatgtaaat atgtaatatg taaatatgta atatgtaaat atataatatg
9301   taaatatata atatataaat atacataata tataaatata taatatataa atatataata
9361   tataaatata taatatataa atatataata taaatatata tattatatat aaatatataa
9421   tatacataaa tatatataat atataaatat atataatata cataaatata taatatataa
9481   atatatataa tatatataaa tatatatggg gaaaaaagct tttatactta ctcatgtgat
9541   taccgtttct tgcagtcttt attcctttgt ttagatcctt gggatttttg ttgctatggt
9601   gaccttagtt ataccaggca cttcaaatct taccttgtgt ttaggaWatg ggcttgtttg
9661   cccaaaggtc ttccctaatg tctgctccac cttcaacttt aggtcttctc tgctgtcagt
9721   ttctctctcc atacacttgt agctctccca ggagtattcc atcgttactt gttagtcagt
9781   gcttattagc ggggtggtgg gatctgagag gtgaggtgct tggttgtgat tctcagttct
9841   gattcctgca ggtactgtgt ccctgggYct tgaagggtat gaccaagcSt ctctgtccct
9901   ccccgcagca gtagttttgg gctcagcaca tattcctgcc ccttcccag aatcagaggg
9961   tttttttgttg ttgttgtttt gttttcaag ttttttgttcc tttttctcca tctgtgttgg
10021  atttaccagc cccctaggag cgtcagtatt tgttaccctt cctccaggct tttaaggcct
10081  ttgtaggaga gatgggccaa tagcatctga gcatggttt gtgtctttct tgtagcaact
10141  gatattcctc acccccaggt ctatgccagg aaggatgctt ccttacatgc ctgtaatccc
10201  agctaccggg gaggctgaag cagaagaatc acttgaaccc aggaggcaga ggttgcagtg
10261  agccaagatc atgccactgc actccagcct ggcaacagag cgagacttca ttcaaaaaaa
10321  aaaaagctc ttacactctt ctgcatattc tgcaaagtat actctgggaa ggctggttta
10381  gaggatctct aacttttcta atatttcata atgcatggct gatgtttaac atgaactcag
10441  actcccatca gattttacag atctgggtct gcttttagtt ctaatgcttc agccagggca
10501  ctttaatctg aggtcacagc attcccaatt gtcagcagta ttttgaaatc taagttcctc
10561  tggtggacaa caggcaacat catatagcca cggaggatct gaacaacttc taagtctgag
10621  Sgatttatc tggtggtttt ggattctttt ccatttatac ttaaacaagg tgacacaaat
10681  gtcactcaca gaaaagccac tcttttttcc cctgttttta agaagtctaa aaatgcacaa
10741  ctatttcctg aatgagcagt gtgtccaggt gtagaatagg gaatgtcgtg tccactggga
10801  acagacggtg tacctggcac aatttatga gaattatccc atgattcctg tcccaccctg
10861  cagcccacca tgggctcagt ggggagtctg agtctctgag ccccaaaggg tagcttttc
10921  ccagacgaca ccagcaagca gagcagcagc ttggggcttt gacaaggagg ctggagtgaa
```

FIGURE 3-D

```
10981    aggtcatatt ggaccatcct ggRtcactgg aggacaatac cccaggaacc tccagcaatg
11041    actggtattg gaatgactcc cctggtcacc cacctgtggc aagacatttg caaacagggt
11101    cttcctatga ggcttgtgag gtttggccaa tttgcattct gctagaatta ttaagtatgg
11161    acatcctcat agatccagaa aagggccgag atccaaagga ttgagaatgc tttgggggt
11221    gtttccatag tgagtggctg gctattcaac agtcaaatgt ttgagaggat acaagtgatg
11281    tgtttcctga ggcaagtggt cagaacccaa cagactcttc tgttcagcta agatgagaga
11341    ccatctgaag ttcttacatg ttctcacaga gaaatggatt ctcataggga aatggatata
11401    ttgtgataga cactgtaagc agagaagttg actgagaaac acacacacac acacacacac
11461    acacacacac gtcaagactg aatgcataga tgtgtattat aaaaagYgta aaaatacacc
11521    accattStaa cagattgtgt aggactatat tttcttttt tttaatttat tattattata
11581    ctttaagttt tagggtacat gtgcacaatg tgcaggttag ttacatatgt atacatgtgc
11641    catgctggtg tgctgcaccc attaactcgt catttagcat taggtatatc tcctaatgct
11701    atccctcccc ccttcccYca ccccacaaca gtccccagaa tgggatgttc cccttcctgt
11761    gtccatgtgt tctcattgtt caattcccac ctatgagtga gaatatgYgg tgttttgttt
11821    tttgtccttg caatagttta ctgagaatga tgatttccaa tttcatccat gtccctacaa
11881    aggacatgaa ctcaccattt tttatggctg catagtattc catggtgtat atgtgccaca
11941    ttttcttaat ccagtctatc attgttggac atttggttg gttccaagtc tttgctattg
12001    tgaatagtgc cacaataaac ataYgtgtgc atgtgtcttt atagcagcat gatttatagt
12061    cctttgggta tatacccagt aatgggatgg tgtgtcaaa tggtatttct agttctagat
12121    ccctgaggaa tcgccacact gacttccaca atggttgaac tagtttacag tcccaccaac
12181    agtgtaaaag tgttcctatt tctccacatc ctctccagca cctgttgttt cctgactttt
12241    taatgattgc cattctaact ggtgtgagat ggtatctcac tgtggttttg atttgcattt
12301    ctctgatggc cagtgatgat gagcattttt tcatgtgttt tttggctgca tcagtgctct
12361    acacgttcag agaaacttct ctagtgacga actatagaaa tgatccctga agtatagtc
12421    ttaggactat attttctttt gacttgggag gcatgtttat tgctgttaat gctgcaaagg
12481    gctctacgtg ctttaaaaaa tcccaatctg ttgcattcat aagcctgggt tggatctaaa
12541    gcagcctccc acttttggaa aggcatcccc acgaccttc catggttgct gaatgcagct
12601    ggaggcagtc acagctggtg atgtccggag cccattcccc actgtgctgg tctgcagaac
12661    ttctgcatgc cattcccaca agcaggtctc tgcctgtc tcctccacct cccttgtcag
12721    aggaagtctg cacttcacag ctttctggtc tcaaccctc tccatccta cagatgtgta
12781    agcagcagga atcaaaaggt gaaggagagg gggcaactca cctccgatgg acacgtgaaa
12841    agtgggagat ggataaaatc aagaaggagc ttaagatatc cagaaatgta aactgtgttt
12901    ggaaaagtaa ggtcaggaga agcatgggac tcctgaggtt gctccctact atcttgcaga
12961    cttgctgcag gaccaaatga agcaggatct gtcaagcacc agggccagct cttaagctta
13021    gtgcctttct gaaccctgtg acccagcagc ctccatcaac tcgtcctacc tgccatgcac
13081    agctcctctg tgcccctgta cctgagctca tgctattccc tctgccagga tgcccttctc
13141    cttctccacc aggagaagaa cacttgccag taagacccag ttctaatgtc acccccttcct
13201    gacggtatca ggaagagtca gtgatggtgt tttatgctcc cagagaattt gccacattgt
13261    gttgtgatta ttttccaca tctgtctccc ccactggaat gagagcctca ctcatcttca
13321    taccctccctg gtctctacct ggtgccagaa ccatcccag ggcagggaa tgctcaggaa
13381    atagatattg aataaaataa gtgtatccat ccatccatcc atccatcctt ccatccatcc
13441    agacatatat acatatgtaa acattctgat ggtcaaatgg aacaatgtgg gctgaagaat
13501    aatgcaggta gaagaaccta agattacaga ttcttgattt gggaggaact ttatttatt
13561    gtgcaaacag tctacaaatt tgaaacatac tctatcaaga aagacactgt tgttaggaaa
13621    gggcgtggga gagggtggcc ccacaaaaca gtgtaaagtt ctaaagaatt tgagaggaac
13681    actctgcggg accctgttcc aagggcatct ttctaagagt ctgtccctta ggctctgccc
13741    cttttggcc acgttgtcaa aggccttctt tatgaacgaa gtgagacaca ttattttgt
13801    tttcttgaat tctaaagtga ttgtcttgag ttccctgggg gagactcctg ggaggtgtgg
13861    cccactctat tccagaaaca aaccaggaga ctgaagactc atcccaatcc catatcccat
13921    gaaaatgtga aatcaaatca ccctgacaa ttccaaaact aaYggaatcc taacataact
13981    ctatgtaact ctaaagctga gtgtgctggt aattaagctt ccagcccacc cttcccagct
14041    ctggggtgca gggtcaccat gggctcctttc ctgtcgtgcac ccacccccac ccccactgtc
14101    agcatcctgt ctccaccctg agagtgacag ctggttccag tagcgggagt tggttccagc
14161    ttgccatttt cctagcactc ctataaccag cctgctgatg cccattcaga gacagcagca
14221    cgggctggcc atgtcccctc tccagaattc tgcgtccagc tcctggacct tgagctctga
14281    gcccttgggc cacgtgtacM attaatagtg cctcctcctc agaggactaa cccccagccc
14341    tagggccacc ttcatatttc Ygagttttga tattttcaac ctctttttctt tgttgtatga
14401    gtccttggc tgggagcttg cagtcaaaat cttcatgata tctcattatc actacttttt
14461    tttaaatctc tactagctgg ataacaatta tttatattaa attctctctt gaaataactg
14521    atacagtgtc tcttgattga aacttgacta gtagactaag aattctaact ctaaataatt
14581    ctgagggccg ggtgtggtgg ctcacacctg taatcccagc actttgggag gccaacgcga
14641    atggatcacc tgaggtcagg agttggagac cagcctggca aacatggcga aacccggtca
```

FIGURE 3-E

```
14701   ggagatccag accatcctgg ctaacatggt gaaacctcat ctttacttaa aaaaaaaaaa
14761   aaatacaaaa caaaattagc caggcgtggt ggcagatgcc tgtagtccca gctattcagg
14821   aggctgagac aggagaatag cgtgaacccg ggaggtggag cttgcagtga gccgagattg
14881   caccactgca ctccagcctg ggtgacagag agagactccg tctcaacaac aacaacaaca
14941   aattagccgg gcatggtggc aggtgcctgt aatctcaact acttgggagg ctgaggtagg
15001   agaattgctt gaacccggga ggcggaggtt gcagtgagcc aagattgcgg cacttcactc
15061   cagcctgggt gacaagagca aaactccatc tcaaaaaaaa aaaaaaagaa aaaaaaatct
15121   gacaattaaa taagaacag aaaaaaaatt tgaatggcaa atacaaagct gaaagaaat
15181   aactgagaat aaataactct gaaaatagct caaaaactaa ataccctcaaa aactctttaa
15241   aaattcagaa aatataatgt tcaaatatga agtaatgctg aaaatgaaat aactaaaaac
15301   caagtaactt gaaaaaaga acataaaaat aaacaactca aatataaaat aactgaaaat
15361   aaatacctgt gaacataagc aactcgaaaa ccagataact aggggaaacc cttcattaaa
15421   acatttcact ctgaaaataa ataacttgac agtagttcat gaacttccag tgagtgttta
15481   atagtcaaat aagttactgt aaaaataaat aactcaaaaa ctccaataag ataaagtgaa
15541   ataactatga aggtaaataa ctcagataat aattgtaaag ataattaaaa ataaattccg
15601   gctgggcgcg gtggctcacg cctgtaatcc cagcactttg ggaggccgag gcagggggat
15661   cacgaggtca ggagatcgag accatcctgg ctaacacggg gaaacccgt ctctactaaa
15721   aatccaaata aaaaattagc cgggcgtggt ggcgggcgcc tgtagtccca gctactcagg
15781   aggctgaggc aggagaatgg cgtgaacccg ggaggcggtt tgcagtgagc cgagatcaca
15841   ccactgcact ccagcctggg cgacagagcg agactccgtc tcgaaaaata aataaataaa
15901   taaataaata aattccaagc aaattaattt gaacatctgt aactcctaaa acaaaacaac
15961   tacatataaa taactgaaaa tgaacaacta aataactttg aaaataaagt aactataaac
16021   cagtaactga aactataaaa ttaaataacc agaaagctac aaagaaatga aaatcaacta
16081   ataaaactaa aaataaaata caactgaaac taacaaaact catttaaaaa ctaataaatc
16141   gatacataaa atacctcaga aagtaacttg aacgaactc tctctacaac gaagcaatct
16201   tggcactaac acgaacaccc catgaacgct cgcagggagg ctgggaggcg gaccgggagc
16261   tcccagtctg cggccccccgc cgggttKgag cggctccggc tcctccaagg ctcgggctaa
16321   gcggctctca accgattccc accccgccct ggagaaatgc gggcgtgtct gcaggcattt
16381   ttgattgtca cgatttgggg gcggggtgga ggatgggggtg gcgcattcct ggcacctagt
16441   gggtagaggc caggggtgct actaaacatc ctaccgtggg agcacagaga agcccacgca
16501   gcaaagaatt gcccggctcc gaatatcgaa gtgcgcggtc gagaaggcgt gggctgcggg
16561   ctctgctcgc ctctgcaggc gccttagagc agctccgagg tcccccgtgc ggagctaggc
16621   gcgcacccag gacacccctc gggctcctcg gaggagccc tggttgtccc ctttctgccg
16681   ccgccgaggc tccggctgct ttctgcgtag ctgggcaggg cccgggcccc cacaccgcct
16741   ctcccgggaa tgcgggcgct ctggagccga ggagcggggg cgtccgcagg gaggtcagct
16801   ctcctgggcg gaggtcctcg ggcgcagcgc cctcgcctgg aaaccagccg tcgcccccgc
16861   aggagccagc cggcccgtgg acgccccagc gcgctcctcc tcggtgctgc gggtcgccct
16921   gcaattccga gaagaaagtc agagacgccg tggcccaaag aggcgcttag tcttccctcg
16981   ctcacactca cgtttcctcc tcatcgcgtt cttctttttc tccctggctg ctttctcccc
17041   tctccaggaa agcagatttg gaggaacagg tttcgtgact gtcgtccgac tggaaaaggc
17101   ccgcgagctg gaagggaggg gacgggtgca ccctcagagt tattgctgga ggctgtggcc
17161   agaccgggca aggtggtgac tccgctggc aggctgaggc ccaccccagc cctcccacct
17221   gggccacggg gctctcagcg ggagcccag ttatgaccgg acaccagcgc accgccaagg
17281   agacagccac gtggggacat gctggactag gagggtcaga gccagtttga gggtctggtg
17341   acctcggctc cctggcttaa ccaggtcctt atgggtgaga atcctgagga gggggagagg
17401   gatggaggct agggacagga ggcaggagga gctgatgaat aggaaggag gaagaagatg
17461   aaagaaacaa aagggaagta attacactca gagcactgct ctccttttcc atgtcttctg
17521   cgccttcaca gtcttcaaag gtgtccatgg agctaaactc cctgctggag cagccttagg
17581   gagagaaagg gaaggatggg gcctctgtgg ggtgggagga catcccctct gcccatggca
17641   gggtgtagca ggcagtgcct gttgcaggca cggtcctccc catctctaac tcctgctctc
17701   caagggcctg cactgcgctg ggctgtgagg gggtctgtga tctccaggct gcttttccag
17761   cgccagatg ccgtaattca ccgagaaggc cgtccacat gctgttcatg ccctaccctc
17821   cccgttcctc caagaaaaca gtcattgttt tttgtgtttg ccagtcttct aaccacgcct
17881   cctttccttc ctcctccct gtctctttct cacctccc tccttgcctc cttttctctc
17941   ccctaattaa tgtccatttc ccatctcct ggcagcctct gccaagtgtc actgctcccc
18001   ataagggaaa atcagaggaa caagcaagtg catccatcct gcctctctct gcagtgaact
18061   gattaattaa tccatcagtc ttgtctatgg cgcacatgtt acatccctgg ggcggtgttg
18121   gacactgtgg ggaacagcag ccactgccaa atactgaaca actgccctgt gcctggtggt
18181   atgttaggca tttgtcaaag tttaagcctc acaaccctgt aagggtctca gcccccttta
18241   cagttgggga aacagacagc aatggtcact tggccaagtc ctcttggcct gtggcagggc
18301   agctgtcttc tccagcactc ctgctcttta ccctcgctct gagtgagatg gagtctctgc
18361   cccacatggc tcacaagcca gggtagggag cagagcatct gcagaaaggt cccaacacag
```

FIGURE 3-F

```
18421    gacagcccca gaccgagggt cagctgagta gtctacgcgg cgggagccgt gctaggaaag
18481    tgtctgctca ggcgagaatt cagggaggtt tgggcaggac ttgaggggca gacaggactg
18541    gagagggagg gcattctggg cagaggcatg gccagagggc ggtaggcggc agtggaggga
18601    gctgcagtta tctgggtgag caggcagcac aagtRgcgtc tcctgggctg ctgccccaag
18661    cccccaacaa gccacgttct gggccccagg ccctccccag agcagatcag tggggctgt
18721    gtgagtaaca tgggggcggg ggggcagctg ggcagcacct ccctggaggc ccctctgaaa
18781    tcctgcctga ctctggcagg ctccgagggg gctggacacc ctcctctcag gttgaagcaa
18841    gtcctggttg agttcctagt cccaggaggt gggaggggca aggggtggag ggcagaggag
18901    aaactgcctc agggatgtgc ccctgccttt catcctccag acaggacttg ggagcatcta
18961    aggaaaccca agactcctct ttagagaagt catccagccc tggggtcccc ttatgccagg
19021    agcaagcagt gagaatggaa gaatgattgt cttgctgaaa gttctgtgat ggagggatag
19081    agggacagag ggagccatgc ccttgaccat cccctgcatg aataggaagg gctgtgtctc
19141    cagggtccat ggcctctgtg ccccggatga tgccagggct gctagggacc atagagccac
19201    ccactgggag gctggcggtt gggcctggct caggagcctt cgtcagccat aggcagccac
19261    agcctggggt gggcagggct gggaggcgac acaggaactg aaaaacctga caagctctag
19321    cccctccgca gggtaagtgg tacctccagg taaaatgatt agttKgttcc agcccctctg
19381    cagggtaagt ggcacctggg gtaaaatgac tgcctggagc tggcagctgc tttccctgct
19441    ctcgcgggcc ctgcagggaa gcggggaagg gaagggggca cagcgctggg cacagagggg
19501    ctctcagacc ctggactcaa ctgtttcagg gtcatctgaa acagtcaact gtttcctcta
19561    gcccattccc tgcctccagg cgaggatttg cctgaacgtg gaaagaggaa ggatcctccc
19621    agtgctgtca accccagatt ccacctccct gtggggact gtcagcgcag gccctgacaa
19681    cgcagagaaa gacacaggac ccacctgggc cagtgacagc aggagctccg ggtgccacag
19741    gtgagggtgg ggatgcctgg agcaccacgg ggggcctggt ttagtctaga gccaggtttt
19801    ccatacacct tagagtgcaa cctcaggag atgcaaattt tacccctaa cacagcatac
19861    acgcagaaac acatttatac aattcaaaca caagcggacg gaacaatatt tacccttaga
19921    gtgtgtgaag tcctcatctg tcccacctca tcctatcatg ctttgttcta tcctaggaga
19981    caaagcagga ggggggctg cggaggtggg ggagtctcat ccaagccctt gggtgacacg
20041    tctctcctga gacaaactgc agctgctctg ggtgtgccct cgcctgtctc cctccaggcc
20101    ccgggttcct gccagcagag acagtaacct attcaccagg tatcccccag ggctcctgga
20161    agaaactcag aattctcaga accagaaaac cttagagagc atcctgcagg caaagcccct
20221    ggttctctgc ggaggaaagt gcggctcaca gggtgccccg ccagggatgg taattgacca
20281    ccaggctgtg tgccttgtgg ggactggctt aaggccctgt gggagctgag tcagggccag
20341    gaccggggtg tcctgactcc tagagatcat gttcccttcc tcacccaggc cttccagtcc
20401    cagccctggg ctttttattta tttatttgg agacagagtc tggcttgtca cccaggttgg
20461    agtgcagttg tgtgatcacg gctcactgca gccttgactt cctgggttga actgatcctc
20521    ccacatcagc ctcctgagta gctgggacca caggcacatg ccaccacacc cagctaattt
20581    ttgtattttt tggtagagat ggggttttac catgttggcc aggctggtct tgaactcctg
20641    agctcaactg atctgcccac ctcagcctcc cacagtgctg ggattacaga tgtgagccat
20701    catgcccacc tcctgggctg actttgctg tcttacatca tctgcatatt taatcccctg
20761    ctggattcac tggtcatggg ctctgaggcc ctaagagtct taggcactaa ggagctggca
20821    gcactgaggg gaccccaaaa tctcagactc aggatctggc cagtcacagg catgtgaggg
20881    aacaactgag aggcccattg ccccatggca ggagaaggtg ctctggagtc agtcagacct
20941    gagggcagtc agacctgatt ctcactctgt cactcactag ctgtgtgatc ttggatacat
21001    cacttaacct cttgagcatc agcttcctta tctctaaaat ggagataata acatcgattt
21061    tgcagtcttg gtatgaggat tagcaaatct tctgataaag aaaaatgcct ggtacatcat
21121    aggaattcaa caaatagtac ctgttatgat tattgtgtat agcaattaca ataatactaa
21181    agagagggtc tcaaaacagc tctgggcact ccaggtgtgc tattattact tacatttcag
21241    ggaggtttgt ctgccattgt ctcatcctca taaacactca gggaaagaaa cattataagg
21301    ataataaatg gctttaaaaa gaaacagagc aaacacacac acacacacac ccctcagaaa
21361    aaccatgcca aacacacagg ctcttgacaa atattcaatc tgattatagc aaaactgttt
21421    tgttttgttt tgtttttttg tttgttttg agacagggt ctcgctctgt cgcccaggct
21481    ggagtgcagt ggcgtgatct tggctcacag caacctcctt ctcccgggtt caagcaattc
21541    tcctgtctca gcctccagag tagctgggac tacaggcaca tgccactatg cctggctaat
21601    ttttgtattt ttagtagaga cagggtttca ccatattggt caggctggtc tcgaactctt
21661    gatctcaggt gatccacctg ccttggcctc ccaaagtgtg agattacagg cgtgagccac
21721    catgcccagc tgattatagc aaaattctaa gtgatagttg tattcttgga aaatgaatgg
21781    aacgactttt gtcccagcca agatctagtg gtgtgttgga gcagatacac cctgagtctc
21841    tggggcactc tcagtctatg tatcagataa gcataaggag tattggtgga gaaggacaag
21901    aatgggaaag gtgggcgatg agaattcctg cagataagga ctggtgagag tattctcttt
21961    tgaaacccctt agtcgacaat ctttctggtg catatcagat aagctgaatg gtttaggaaa
22021    tctagtgttc acatttagtg cttagaattc taagcttttt tattttgctt aaacaaatgg
22081    aatgaaattt attaacaagt gaacctagta atgagctgaa attattctca ccagcataca
```

FIGURE 3-G

```
22141    tatttttggt aaattataga ctttgaagac aaaatcatgg tgtttccctt actgtccagt
22201    ggatggcaca aagagaccat tgtagatcct gctggttcag cggtagctct caatccatag
22261    atattaaatg ggcaaattct attttttattg tctttcaaac tagattttc tcaatgcaca
22321    actttttttt tcttttttctt tttttttttt gagacggagt ctcgctctat tgccaggctg
22381    gagtgcagtg acacgatctc ggctcactgc aacctccgcc tcccgggttc aagtgattct
22441    cctgcctcag cctcctgagt agctggggac tacaggcgca tgccaccatg cccagctaat
22501    ttttttgtaa tatcagtaga gacagggttt caccatgttg gccaggatgg tctcgatctc
22561    ctgaccacgt gatccgccca ccttggcctt ccaaagtgct gggattacag gcgtaagcca
22621    ccgcgcttgg ccaattatgc acaactttt aaggaccatc tctatcacat gaactaaagg
22681    atatcatttt cacttggggg tgggaagtgg tgagctgctt aaaagcaatg cctaaacccc
22741    ctgggctttc cttcctttca cttggaagaa ccagggggta actaactgct aacaattcca
22801    tgctttcaga gatctaggcg caagcctaag ggcttcatct catttaatcc tcatggcaag
22861    actgtacagt attatctcca ttttgtaaaa tgaatgataa aagaactta agcacagaca
22921    ggctatagaa tccatccaaa gagatggagc tgcacttgag gctgggtctt tgagacctga
22981    gtttgagccc ttcatcattg tgttgtgtgt gctgctaacc aatttcccct ctctgtcttc
23041    taggatttaa tacatggtgt cacattctgt ctgatccatc ccagtagctc tccagagctc
23101    ccaacaggag agagttccaa aatgtttcca ggggtactag gctcggttac aatattttgc
23161    ttggtggccc agagtataaa cgtggatatc ttaggctggt ctatagctga aacgtctatt
23221    tcatttgcaa gcctatcttt ggctaagagg aagtgaatca ttcttgagaa catctaatta
23281    attgctttca gattccacat gttgacattc tcagggcaca tttttttttt cccgtgcatt
23341    tctgttgtca aagtccctgc cagctcctaa ggcagtctga gctggctgtc ttagactttc
23401    agagctgctg gaagcttggg ggagggaggg gctgtaggtc aaagaaactt tataacctag
23461    ctttacctcc cagctcagcc accagctgcc ctcaaatgtt ctggattgga ataagcccaa
23521    agatgagtgg caggagggaa gggcaagcca atacgtctag tttggttcag tcaaagcctt
23581    gcccatttca tcagaatttt aatggaaaat ttccaataag attaaaatat aaggtcaccc
23641    caattttagt atggctccat ttaaaaaaaa tcatgcatat ctttgttttg caatggggcc
23701    ttactcttgc ccaggagagg tgcggtggta caatcatggc ttacggcagc ctcaacctcc
23761    tgagctcaag caatccttc accttggcct gccaaatagc taggattaca gacacccacc
23821    accatgccca gctaattttt aaaaaaaatt ttttgtaggt ccagtgcagt ggctcatgcc
23881    tgtaaatctc agcactttgg gaggcggagg caagcggatc acctgaggtc aggagtttga
23941    gaccagcctg gccacaatgg tgaaactgcc gtctctacta aaaacacaaa aattagcgag
24001    gtgtggtggt gggcacctgt aatcccagct actcgggaga ctgaagcagg agaatcaatt
24061    gaacctggga ggtggaggtt gcagtgagcc aagttcgtgc cattgcactc cagcctgggc
24121    aacaagagtg aaactccgtc tcaaaagttt ttgtggagat ggggtcttgc gatattgccc
24181    aggctggtct caagctcctg gatatcaagt gatcctcctg ctttggcttc ccaaagtgtt
24241    gggattacag gcatgagcca ccacaactga ccaaatcatg catttctata gacaacgtct
24301    gcaagaagat attaatggtg attatatctg gttatgttgg atttgtattt ttatttgtac
24361    tttcctgtat tttctaaatt cctgacattc tacatgtgta ctcctttaat aatcagaaaa
24421    ggaaacttaa aatagttaaa accaattggt cagatatgta aaataaccca ccatctctcc
24481    agagagggct gtttgctaga acttatttc ttcattgaaa tactagagtg ccccaataag
24541    tttgaataac acaaaaaaaa agataatgaa agtaactaaa ttatctaggc caaaaggaa
24601    atgccacaaa aattggcaaa gaaacaacca tgacgtgcta taccggatag ctcctaggcc
24661    cccttggaga ccctgaggta cccgacgagg gacctgtagt aaggctggca gacaggttct
24721    tcctctgtta gctctgaggt acaacagtta ttctcatttt tatgtctttc acatggccag
24781    aactttgcaa atcagaggca aagtgaattc agaattaaaa attttcagca ccatccaagt
24841    cagtaaaaca gtcttagctt ataaccttta ttttttttat tattttatta ttttttttatt
24901    tttggatgga gtcttgctct gtttccaggc tggagtgcag tggcatcatc tcRgctcact
24961    gcaacctccg cttcctgagt ccaagtgatt ctcctgcctc agcctcccga gtagctggga
25021    cgacaggcat gcgccaccac gcccagccaa ttttgtatt tttagtagag acggggtttc
25081    accatgttgg ccaagatggt ctcaatctct gacctcctg atcctcccgc ctcggcctcc
25141    caaagtgctg ggattacagg cgtgagccac gcgcccagc cctttatttt tactgtaagc
25201    tgccagtaaa cagcacaccc acctgtctgc tgactgtccc atctggaagt tgtgtaggtc
25261    cttactgaat cttaccttct tcccttcccc tacccagacc catcccagc tggcacgtgg
25321    aatcctttcc ctttctcctc atgtcaatag accagcaggc aaagagagca gttaccatag
25381    tgaaggaga acgggtcct agtcgtggtg aggaggtagg gctgctgctt aacaRaggcc
25441    gagagggaca tgtctgatgc tcaggtgatc cactaggaca tctcgcaata ctcccatgcc
25501    cagctgtaac tatgatggcc aagtccaaga accatagcct gataagagtc taggacccc
25561    actatacatg ccaccagtag aagtgcctga tggggagagg gatgtctaga atgagtagga
25621    gggaatgatg acaaagcaca gccaaggacc aactgcagtg gcaggtggca gccacagatt
25681    gagttaagta ggattcttgc tgtgttccct agtggaagca tctcccttgt tgagacccac
25741    tgaggttaaa gttggagaca tggggagaaa acaatgtccc cgtgttcatc actagagtca
25801    tgatgggcaa ggtcacaact catttgactt cttggctccc agattcatat actctgcctc
```

FIGURE 3-H

```
25861    ttgggggcac ttcaccataa tacagccatt ggttcagttg tatgctgcat cctgagggac
25921    agcactccat ccccgcagtg ccatgtccaa actgctgccc cgcctcactc tcaagaggct
25981    gtcccactac tctgtcaggc accagcttct gaatgcagtg gtaagactct gtcctgtgat
26041    cacgtctatg gctgattctc ttttgccata ctgagtcccc tgatcaaagc agtgttatac
26101    agcctggcgc gctggctcat gcctgtgatc ccagcactct gggaggcaga ggggatgga
26161    tcactagagg tcaggagttc aagaccagcc tggtcaacat ggtgaaaccc tgtctcctct
26221    actaaaaatt caaaaattag ctgggtgtgg catgagcctg taatcccagc tactcggaag
26281    gctgaggcag gagaatcact tgcacccagg aggtggaggt tgcagtgatc cctgatggtg
26341    ccgttgcact ccagcctgag cgacaagtgt gaaactctat cgcaaaaaaa aaaagcaacg
26401    cttatgattg atcacacact gtactttcta acctgaaggg gtctggtaaa atcaacttgt
26461    cttctcaagg gacagtacca aactgggggc tcagcactga cctctgctgg catgtcggac
26521    atttaaaagt ggtagcagct agagcagtct tgaagacatg gagccctcac tgctggggcc
26581    gagcactgct gggttcaatt ctgctaccaa ggcttctcca tttccgagcc catggtgcag
26641    gcactggggt gcctaagagg aagtgcacta actggacttc tgctatgcac cttctttagg
26701    gggcattaaa gcacagttca aagactctca catttttgagt taacccccac aggcctgtgt
26761    gccccttctc cagtcaggtc atgttgtcat tgatcctag ttattattct gaaagggttc
26821    aggaagggag gtggggacag atcttgRaaa gggcaaacat tgccttgtat gcctcatctg
26881    aggcttccgc atagtcttag gggactggga accgtcttaa gtaatctca ccttcttccc
26941    ttcccccagc caggccctag ccctactggc atgaggaatc ctatctcttt gtcctcatgc
27001    caggagacca gcaggcaaag agagcagtta ccatactgga aggagaaatg ggtcctggtc
27061    atcagaagga ggtactcctc aagggacagt acctgaggga gacacttcca ctagggaaca
27121    cagcaagaat cctacttaac taaatctacg gctgccgcct gctgctacag ttggtccttg
27181    gctgtacttt gtagtacaag gcgaagtagg ccactgctgc cagcccagga ggtcaagggc
27241    atttacccag acatcctcat tcccagtttt tgggtcccct atcttccctc tcaggatcta
27301    atgactcatc tactggcact aggagtccaa aatgaccaga tggcagactc gcctaggctg
27361    agaattcttc cttctctcaa attctgccac ttttaccagc ccagtctgcc tctgctgtag
27421    gagatgagag gctaaatgtt ggcagggagg cccctgatt ctgatcctgt gttttaaatc
27481    gataattagt cYgaccctgt tactttctcc cttcagtgca tcaacgggag gctcttagca
27541    acagcctccc aactctacct tcctgataga taatattttc ctcaaagctc tcaaatgcta
27601    gagacattgc accagctggY gtgtccccat ccacctgtat ctgatcccag gtcaccacag
27661    gtgaaggtct gagcaatYga actgctacag caggccaggt accaggactc tcaRcacgcc
27721    acttaacacc aataatgagg tcctcatggc catttggcct gcagtgagcc aacaccagaa
27781    tcccatccat tctgggaccc ctcctgctac taacggtctt cagtcaggtt ccccagaagc
27841    agattatgca aatgtgttat tgaaaaacgg ctttcagatg aaacctggaa gacagtgaag
27901    gccgaagcta gggcagggaa gaagccaggc acagacgtgg gcttagcaga agtctagcat
27961    cagcctgatc ccctgggcag tactggagca tggatggcac cacaggttac catcttgaga
28021    cagaaggact ggcttctgta ccctgaatca gtaagccatt ggtgggccat aagccaccct
28081    tagggagga cataacctca caggcatttc ctggctggac gaccctgggc agctgagggc
28141    aactgcctga agggcacaac ggtgagccat tgtcagctaa cctcacagca gcagagacat
28201    ggggccaaca gcctataaag agggtctggg caggctgtca atactctcta ctgtaatact
28261    gtatatgtgg tttattttaa aaacttttt agaaggcttt attttatttt atttttttgag
28321    aaggagtttc gccttgttg cccaggctgg agtgcaatgg cgcgatcttg actcaccaca
28381    atctctgcct cctgggttca aggaattctc ctgcctcagc ctcccgagta gctgggatta
28441    caggcgtgta ccaccatgcc cggctaattt tttgtatttt tagtttcatc atgttggcct
28501    ggctagtctt caactcctga cctcaggtga tccgcccacc tcggcctccc aaagtgctgg
28561    gattacaggc gtgagccacc gcaccggct gactttattt ttttagagca gttttaggtt
28621    cacagaaaaa ctgagaggaa ggtacaaaga tttcccatat atcccctgtg ctcacacatg
28681    catggcctcc ctatcaccat ccccaccag agaggcacat tgttacaat ggatgaacgt
28741    atacactgaa tatatcatat tcacccaaag tctgtagctc acatcatggt tcactttggc
28801    tgttgtacat tccttggatc tagacacttt tataatgaca ggtacagtag tccccctta
28861    tcctcagggg ctacttccaa gatccccagt ggatgcccga aaccgcagag agtgccaaac
28921    ttgactgcca tcagtgggaa tatgtttcta ttcgccttcc accaccacg gtttaacgcc
28981    ttttttcatct tagtgctgct gccgtaactt tggcagtttg agatgcgaca gcaaaatgag
29041    tacaaatttc tttctccttc ttcacaatgt catggacaga tgattccttc ttaccataga
29101    tcttagcaac tcggtgtgt gattttttt ctttcttgtt aaatcaactt tcaccttttc
29161    acttaaagga agcatttgac ggcttctctt tggcatatct gaatttccag catcacgact
29221    gtgctttggg gccattgttt gtttatttat ttatttattt tatttattt tttgagacag
29281    agtctcgctc tgttgcccag gctggagtgc agtggcgtga tctcggctca ctgcaagctc
29341    cgcctcccag gttgacgcca ttctcctgcc tcagcctccc gagtagctgg gactacaggc
29401    gccaccacc aagcgcagct aattttttt tttttttgta ttttagtag agatgggtt
29461    tcactgtgtt agccagggtg atctcgatct cctgacctcg tgatcctccc gcctcagcct
29521    cccaaagtgc cgggattaca ggcatgagta ttttattat ttatttattt tttcagacag
```

FIGURE 3-I

```
29581    agtctcactc tgtcggccag gctggagtgc agtggcacca tctcgctcac tgcaacctcc
29641    gcctcccagg ttcaagcaat tctctgcctc aaactccgga gtagctagaa ttacaggtgc
29701    acaccaccac gcccggctRa tttttgtatt tttagtagag acaaggtttc accatcttgg
29761    ccaggctggt cttaaactcc tgacctcagg tgatccaccc acctcggcct cccaaagtgc
29821    tgggattata ggcgtgagcc accgtgcttg gccttggggc cattattaag taaaataaga
29881    gtcacttgaa cacaaacact gtgatcctaa cagtcgattt aatcaccaag atggctataa
29941    gtgactaagg ctggcgggt ggggagcaca gacagcaggg acacctgga caaggggata
30001    attcgtgtac caagcaagac acagcggaag cgccagatt tcatcgcact actcagaatg
30061    gcatatcatt taaaactcat cgattgttta tttctgtaat ttttccattt gatatttgga
30121    cagcagttga ctaagagtaa ctaaaacctg gaaagtgaaa cagtggataa ggggtgctc
30181    ctgtacttct caatgtgaga catttgccct tcatgttaat tctgccccat tagYtctaca
30241    caaatgaata gcaggaaatt gattttaaac cacatggtgg taaaatgctt tcttttttct
30301    ccctcattta actaaagaag ggctgggccc taggtgatgt cttccttagc atctaagcag
30361    ctggcatcac cccactgctt ctgtgctcca ctctcccatg ggaccctccc tacctttaat
30421    ccctcctgtg ctggaggccg ggtcttcctt gctagtggta gctcttcca tattttaat
30481    ccatggtccg gatcctgctc cactgccttt gctttagaga aataaacatg aatattgagt
30541    cactggaagg aatgacacac gcatccctcc cccaccagtt ggagtaacgc tggcccacct
30601    agtgtatctc tggtctaggt ctcgaggacc tgctgctcct ccctcacctg tagttgaaga
30661    cctgcctcag gtcagtaggt gatacgcagt aaggaaatgt ccaaaggaca cttcttgttg
30721    gattacacag caaacatcta attggctgca aatctttttt tcttttcttt tctttttttt
30781    tttgagacag agtctcgctc tgttgcccag gctggagtgc agtggcgcaa tcttggctca
30841    ctgcaagctc tgccacctgg gttgacgcca ttctcctgcc tcagcctccc aagtagctgg
30901    gactacatgc gtgtgccacc acacccagct aattttgta tttttagtag agacgaggtt
30961    tcaccatgtt ggccaggatg gtcttgatct cttgaccttg tgatccgccc gccttggcct
31021    cccaaagtgc tgggattaca tggctacaaa tcttaaaggg ggaagagatg aggaggaata
31081    atcccctttg tcttctcaaa aatgttttca ctggctcact acagctccct ccttcctctt
31141    tactgaccca aaatgccaac tattatagta actcttttgg gttagacgaa tccagtgaat
31201    aaacacctac taagcattgg aggtccaaga ggaataagat atgcctgagc taaacctcat
31261    caccccggc cttgcttgca gagtggtttg ctggcctcat ctgattattc aatgagtgct
31321    ttcatttgtt tattcactaa atatttactg agcacctaca aaagtgcctg gcctggtag
31381    atgaggcctg agggaagcta aaactaataa gacaaactcc atgccctaga ggaattcatg
31441    gtctcatagg gagaaaatgt aaacacatca taaaattata gcttattaaa tgctgcaata
31501    gagtactccg taagagtgtg ggggcagaga ggaggggag aaacagctgc tttctagagc
31561    cctcaccttt tccacttctc tcatctttct gggttagggt ctagcgggg ttccatgagg
31621    atcaggctaa atgagcttag aaaaactaag cagactactg tatcagaact ggatcacagt
31681    agacaggcgt tttcaacaaa catatattga gtatccctga gtgctttgga caggaagagg
31741    aattatagac gaagattgta agtcgcagta atagatgagg caaggagcac cagtgaggac
31801    ttaaccctga aagaagtgtg agcacatctt cctcccagac aagggggaat aaagaaagga
31861    agatgatcag gagagttcta agtggaactc agcagccaga ggggaagcYg gaggaggtaa
31921    catcagaggg tgcgtttgcc cactcagtaa agtaggaggc agggcagcct tgtgaaaata
31981    ggaatggaat agaaagctca agaaacagc caaaagcaag ggcaattagg ggaggtttcg
32041    aactggcaga tctacctcaa ctggcaatac agcaagcatg caccagaaaa gatatcctag
32101    ctagcagtgg ggttgggaac tgatttaata tcctaggcta gcagtggggt tgSgaactga
32161    tttattattt aattttttat atctattcat gtatttatgc acttatttat ttttgagata
32221    ggctctcgct ctgtcacaga ggctagagtg cagtgatgtg atctaggctc actgcagctt
32281    tgacctcctg ggctcaagtg atcctcccac ctcagcctcc tgagtagctg ggactacaag
32341    cacgccacca cctaggctaa ttttgtatt tttttttgtt agagacaggg tttcaccatg
32401    ttgcccagge tggtctcaaa ctcctggcct caagtgatcc atctgccttg gcctcccaaa
32461    gtgctgagat tacaggcgtg agccactgcg cccagccaat atttttaaa aattggaaat
32521    cccttgtaat aagccaagtg tggggggaag aaaagcaata aaagcaatga catggactca
32581    atatgaaaca tccaaagcat ttgacatgcc tttaaaataa aaaatcagt actcaccctcg
32641    tgctcatttc aaactgtgga tttccttggt ctaaaattt aaaaaacaaa aacagcact
32701    ctcaaattta agctaatttg aattgatttt acatagtgat ttttaaatac acatatatgc
32761    ataaagagaa tactataaaa atatataaag gtgtgtaggt cttgatcata ttttcccagg
32821    aattcagaaa acgctgctac agtccctggg ctcacgtggt cctggcatcc tccccaacgt
32881    ctctacccca tcctgctgag tttctggcat gcattggttc tgggtctgtc caagtttcta
32941    ctgttagctc cattaatact gaattaagga ataaacagtg ctcaaatgct catttttttcc
33001    atgtgagccc aaattatgtg acttgatgag ggaaaaaatc atgagtccct gggagagcga
33061    taagaatcac attctttact aaagtgttgt cccaggtatg agaataacac cagatctcaa
33121    cctccagagg cccccactg cctcccacag cataaaagcc aaattcctcg gcccgatatt
33181    tgaggccatc tcaatctttt tccttcacc ctatacctga ctctcccagg ctaggctcag
33241    atcgtcactg aatgtgctca cttcgaggca cctctgtgat tttcaaggtt cctgggccca
```

FIGURE 3-J

```
33301    cctttactact ccgatgtgac tgccacatgt tgcccagttg ctaggatggg accgtggcct
33361    tgatttctgc cgggactgag gctttgcctt gtttcccacc caccctgctg cctgccoctg
33421    cactcttctg gctggggcct gatctttccc cgcagtctcc cttcacctct agatcacagg
33481    cagtcatgcc acagctgagg agcttgtccc aaacctcagt gcctgcctcc ctcctcggct
33541    tcttgtgctg ctgtgtctca cccatcagtg aYgctcttct cttccctgcc caagccctag
33601    ctgactccat aacacctgga tacaatgtcc tcttctgtct ggttacctcc gagaggccct
33661    ctctctacat ccctcattgg ctcccagtgt cattcctctc acccatggcc ctaaggtcac
33721    tgtattcttt ggccagtgta cagggttatt atgcttaaca atccacaaag gttgaaaggt
33781    gttgtaggat ggtgtaaaaa tgaatctggg tggtaatgtt tatatgtcag agctttgtaa
33841    agtgctcggc aggcgtaagg tactgacagt cctgatattc ctgatcttgg aacctgggac
33901    accatcttct caacattgcc cggatacccct caagggtatc cagacagcct gagtttgcat
33961    tctgttcctg gttcagccca gggccctggt tcccgctcac tcaccatcca ctgtgggccc
34021    tctctaaatt cttaaagccc ttgccatttg catcactcac agagacattt catcagagcc
34081    tacttggtgc accaggctca ggagactcag ttctgctgcg gataagttat gtaaaattga
34141    ccctctgctt gcacatctgt aaaaggaagg ggctggcaca acacctctgg gcctttcagt
34201    tcagtagtgt tttcttttta tctaaaccac gtgctgggtc ctggttttgc ttcttatcta
34261    gattttttgca ttcctgtcac aacctataaa gcacagttca ggccttaagg agggcttgag
34321    aaatctcttt ccgaattgtc aactgaataa gtgtcatatc ttcataacaa acttgtcttt
34381    ttttgcaggg ccaggaaggc agcaggggag tcagttaaaa tataaatttt agattaagct
34441    taatattgtt aagaagtcaa ttctcaccaa attgttctag agattttaca taatcctaat
34501    caaaatctca ataaggtttt ttgagaagtt ggcaagcaga ttctaaaata tatatagaag
34561    tataaaggac acagaataat caaaacaact ttaaaaagga agaacaaaat tataggactc
34621    taactacctc attttaagac ttattagaaa gcagcagtaa ccaagatagt gagggactga
34681    tgtcaaggta gacaaataga tcaatggaaa agaatcaggc atccagaaat agatgcactt
34741    acataaatca tcaattggag aaagaatagt gtttttaaca actggcaatg gaaaaactag
34801    aacatcagta tgcaaggac tgaactttga tccatacctc acccacata caaatcaaaa
34861    acagaaacaa acaaacaaac aaacaaatac tcaaaatgga tcagagacct aaatgtaaaa
34921    ctataaaact tctggaagaa aacacaggga gaaaatcttt atggctttta gataacgatt
34981    tcttaggcag gataccgaaa acatgataca tacagttttt aaaattaaat attataagaa
35041    ttaaagtctt ttgctcttca aaagtcactc ttaagagaaa aagatgccac acactagaag
35101    aaaatattta caaagcatta aaaggacata tatctaggat atacataaaa actctcaaaa
35161    gtcaatáata agaaaacaat gagcaaaaga tttgaacaga cacttcacca aagaagagat
35221    aaagatggca aagaagcaca taaagagatg ctcaaccatt agttactagg gaaaagcaaa
35281    ttaaaaccta atgacatacc actatgccc tattagaaat ctgaaaattt aaaagactga
35341    caataccaag tattggtgag gacatggcac aagtggaact ctcatacatt actatgggaa
35401    tggaagatac tataatcact ttggaaacta tttagaaatt tcctaaaaaa ttaaacatac
35461    acctaccata tggcctaacc attacactct taggtattta cccaagagaa atgaaaacac
35521    atgtccacac aaagacttgt acttgcatgt tcatagcagc attattcaaa atagccccaa
35581    agcagaaaca aatcggatgt tcattaacaa gtaaatggat aaagaaaacg gggtctagcc
35641    aaacaatgaa atactactca gcaacaacca aaatatgtac tattgtttac aaaatccaaa
35701    tagatgaatc tcagaataat tatgcagagg agagaagcca gaccaaaaaa aaaagtacat
35761    agtgtattat ctcttatgaa attctagaaa atgcaaacta acctatagtg acagaaagga
35821    gattggtgtt cacctggggt gggtgaggga ggggcaggag aaagggaatg caaagcagtg
35881    tgaacaaacc tttggcggtg ataggcatgt tcattatcct tactgtggtg atgccttaca
35941    gatgtataca gatgtcaaaa cttatcagat tgtacacttt aaatatgtgt ggtttatcgt
36001    gtcattatac ctcagtaaag gagttttaaa aattgtagta aaggtctct  acctagaaac
36061    cttaataagc taaaatgtat gtccccagga ctaaccctag ctattctata gttctggggt
36121    ggaacctaga aatctgcatt tgtagcaagc ccttcaaata atttgaatgc aggtggtcct
36181    taaccaccc tttgagaaac actgacctag tgagtaagga tttctaaaca agcttgtgac
36241    tagaatgttg tttctgcagg gaacaagtga cttttttctac tagagttgcc atatcattct
36301    gtgttaagcc tctaggacac tcctactcaa ttaccatgac atatatttaa cataatatta
36361    atagttgtaa aacaaaagta aaccatagtt ttttttccat cttatctgta tacaaagtaa
36421    aatcaatgac ataatattgt tactagttcc tggcagttac ctacagttta aatcaagaac
36481    ttatgttgct tggttttgt gacagaaaac tgatgtggtg gctttccagt tacactgctt
36541    ggtttacctt ttcccttatc ttatgatgca cacccagctt tgcacgttcc tgagcagctg
36601    atgatcatag aagacctaga aaaagtgtga gccagttgca ttcctgctat ctctaaagaa
36661    aaaagttatc ttttcatttt tatgtgattt ttcttaccca aaatgcaaac cactgccagt
36721    ataaatgatg gaagatagac tttccacatg aaactggcat tcttcaccc tagtaacatt
36781    acctgagggg aaggtcagaa ctcaattgat aaagctcgct gtggattttc ccaccaaata
36841    tccctgcaaa caaagtgaaa ggataaagcc tgcttaaaga tgatttgtaa ttgttgaaag
36901    gagtacagtg tgtgacatca gtgaaaatgg tggagaaaaa acccgtcccc aaattctctt
36961    ctttgtgaaa gcatggaaaa aactggccaa aaatggttag aaaatttatt ttcagaatat
```

FIGURE 3-K

```
37021    cgaaatttt   ttttccttt   ttttttttt   attatacttt  aagttctagg  gtacgtgtgc
37081    acaacatgca  ggtttgttac  atatgtatac  atgtgccatg  ttggtgtgct  gcacccatta
37141    actcatcatt  tgcattatgt  atatcccta   atgctatcta  tcccttcccc  ctcccccac
37201    cccaccacag  gccctggtgt  gtgatgttcc  ctaccctgtg  accaagtgtt  ctcattgttc
37261    agttcccacc  tatgagtgag  aacacacggt  gtttggtttt  ctgtccttgc  gatagtttgc
37321    tcagaatgat  ggtttccagc  ttcaccatgt  ccctacaaag  gacatgaact  cattgttttt
37381    tatggctgca  tagtattcca  tggtgtatat  gtgccacatt  ttcttaatcc  agtctatcat
37441    tgatggacat  ttgggttggt  tccaagtctt  tgctattgtg  aatagtgctg  caataaacat
37501    acgtgtgcat  gtatctttat  agcagcatga  tttataatcc  tttgggtata  tacccagtaa
37561    tgggatggct  gggtcaaacg  atatttgtag  ttctagatct  ttgaggaatc  gccacactgt
37621    cttccacaat  ggttgaacta  atttacagtc  ccaccaacag  tgtaaaagtg  ttcctatttc
37681    tccacatcct  ctccagcacc  tgttgtttcc  tgactttta   aagattgcct  ttctaactgg
37741    tgtgagatgt  tatctcattg  tggttttgat  ttgcatttct  ctgatggcca  gtgatgatga
37801    gcatttttc   atgtgtctgt  tggctgcata  aatgtcttct  tttgagaagt  gaccgttcat
37861    atcttttgcc  cacttttga   tggggttgat  ttttttcttg  taaatttgtt  taagttcttt
37921    gtagattctg  gatattagcc  ctttgtcaga  tgggtagatt  gtaaacattt  tctcccattc
37981    tgtaagttgc  ctgttcactc  tgatggtagt  ttcttttgct  gcgcagaaac  tctttagttt
38041    aattagatcc  cacttgtcaa  ttttggcttt  tgttgccatt  gcttttggtg  tttagtcat
38101    gaagtccttg  cccatgccta  tggcctgaat  ggtattgcct  aggttttctt  ctagggtttt
38161    tatggtttta  ggtctaacat  ttaagtcttt  aatccatctt  gaattcattt  ttgtataagg
38221    tgtaaggaag  ggatccagtt  tcagctttct  acatatggct  agccagtttt  cccagcacta
38281    tttattaaat  agggaatcct  ttccctattt  cttgttttg   tcaggtttgt  caaagatcag
38341    atggttgtag  atgtatgata  ttatttctga  gggctctgtt  ctgttccatt  ggtctatatc
38401    tctgttttg   gtaccagtac  catgctgttt  tgattactgt  agccttgtag  tatagtttga
38461    agtcaggtag  cgtgatgcct  ccagctttgt  tcttttggct  taggattatc  ttgacaatgc
38521    aagctctttt  ttggttccat  atgaacttta  aagtagtttt  tttccaattc  tgtgaagaaa
38581    gtcattggta  gcttgatggg  gatggcattg  aatctataaa  ttaccttggg  cagtatggcc
38641    attttcacga  tattgattct  tcctatccat  gagcatggaa  tgttcttcca  ttggtttgtg
38701    tcctcttta   ttttgttgag  cagtggtttg  tagttctcct  tgaagaggtc  cttcacatcc
38761    cttgtaagtt  ggattcctag  gtatttatt   ctctttgaag  caattgtgaa  tgggagttca
38821    ctcatgattt  ggctctctgt  ttgtctgtta  ttggtgtata  ggaatgcttg  taatttttgc
38881    acattgattt  tgtatactga  gactttgctg  aagttgctta  tcagcttaag  gagattttgg
38941    gctgagacga  tgggttttc   taaatataca  atcatgtcat  ctgcaatttg  acaatttgac
39001    tttctctttt  cctaattcaa  tacccttat   ttctttctcc  tgcctgattg  ccctggccag
39061    aacttccaac  actatgttga  gtaggagtgg  tgagagaggg  catccctgtc  ttctgccagg
39121    tttcaaaggg  aatacttcca  gttttgccc   attcagtatg  atattggctg  tgggtttgtc
39181    ataaatagtt  ctcattattt  tgatatacgt  cccatcaata  cctagtttat  tgagagtttt
39241    tagcatgaag  ggctgttgaa  ttttgttgaa  gacctttact  gcatctattg  agataatcat
39301    gtggttttg   tcttcggaga  acactggaaa  ttaaatgatg  gcttgcagca  atctggagag
39361    catttattca  aggaaaatgg  ctgtgtctca  gtatgactaa  tgagcttttt  aacttgccct
39421    atttctatcc  tcccttcct   tggtggtagc  cttagaaatg  aacagcctgc  aatgatagtg
39481    aaaatcagca  gtctggcagc  catgggaggg  gcagaacagg  aatgggggaa  ctatggagcc
39541    tcattcttag  agaattatca  ttatttgatc  tgtccacggg  tttctaggaa  tacctgacct
39601    gcaagtctgt  ctttattagg  cctgactcag  aacttgccca  atgtgaaaag  tcttttcccc
39661    aaaggccttt  gtagaaaatg  attacaggca  attgtttaac  ttcttggttg  ctcgaggtat
39721    tggctaacag  tggggcaaac  atgggctaat  cagaaggttt  aaaatgaaat  gctcaggaat
39781    aagatgctca  tagagggttg  taaaggctcc  aaaatattta  tgagactcta  gaagaccatg
39841    cacacatttc  ctgtgaacat  gttcaggaca  gatctgcgaa  ggccccacga  tcttacctct
39901    ggctgatctt  gatgatctgc  acaaacagaa  agtgaaagct  aggctagaac  tgtcaagtgc
39961    caggctgagt  gtgaaggtgt  gccctaatgt  gcacacagag  ccccttggca  aagactagaa
40021    gacttactgc  tttcaggtgt  ttaaagaaat  ctctgtcatg  tcattagtat  ttagatcact
40081    aagctaactg  aacagaggct  tcaatggctg  cacataaata  cagacttcac  agaattagtt
40141    tagaaaagtc  actataacaa  acaacaataa  acagcaacac  caacaaacag  tagaggtggg
40201    aaggtccaat  ttccagagtt  gctacattat  gttatttaaa  atgtgcaatt  ttaacagaaa
40261    ataatgagac  atgtaaagaa  ataagaaaat  gcagtccata  cccagggaaa  aagaaaaacc
40321    agtcaataca  aactgttcct  aggccaggtg  cagtggctca  tgcctgtaat  cccagcactt
40381    tgggaggcca  aggcaggcag  atcaccagag  gtcaggagtt  tgagaccagc  ctgaccaaca
40441    tgttgaaacc  ccatctctac  taaaagaaaa  atacaaattt  agccaggcat  ggtggcgtgc
40501    acctgtaatc  ccagctactc  ggggaggctga ggcagaagaa  ttgccttgaa  ccaggaggcg
40561    gaggttgcag  tgagctgaga  tcatgccatt  gcactccagc  ctgggctaca  gagcaagact
40621    ctgtctcaaa  aaagaaaaaa  aaagaaaaaa  gaaaaaactg  ttcctgagga  agccaagata
40681    ctgactttac  tagaccaata  ctttaactat  ttttacatgt  tcaaaaagtt  aaaggaaatc
```

FIGURE 3-L

```
40741  atatataaag actaaaggaa agcacaagaa caaatcctca ttaaatagaa aatataaaga
40801  tttgttttaa aggacgaaac agaaattcta gatttcaaaa gtataataat tgaatgagaa
40861  attcactaga gtggctggct caatagcaga tctgagcagg cagaagaaag aattagagaa
40921  ctcagaaata ggtcaattga atctatccag tctgaggaag agaaagaaag aggaatgaag
40981  gaaaaatgaa tagagcctca gagactgtga gataccttca agcacgctaa tgacgcataa
41041  tggcagtctc agaaggagag agggataaat gggctaaaat aatatttaaa gaagcaatgg
41101  ctgaacattt cccaaatctg atgaaaacat taatctatac cttcaagaaa gtctataaac
41161  tccaagaaat ataaattcaa agagatcaag atccacacct agagataaca taatcaaact
41221  gtcaacaaag acaatgaaat tatcttgaaa gcagcaagca catagaagga ctcttcaata
41281  agattaacag ctgatttcta tcagaaatca cagagttgag aaggcaatgg gatgacatat
41341  tcaaagtgct taaagaaaaa gagggtcaac aaggaattct atacctaaag ccaatttatc
41401  ttcaacaaag atgccaagac cattcaaagt ggggaaagaa tagtcttttc aatcaatggt
41461  tctaggacaa tggatatcca catgtaaaaa aaggaacttg ggccctaat tcacatcata
41521  tacaaaaatt aactcggaat gagtcaaagg cttaactgta agagttaaaa ctataaactc
41581  tttgcaaaga acactatcaa gagagtaaaa agacaatgca cagtatggga aaaaatactt
41641  gcaaataata tatctgataa aagtccagta tccagaatat ataaataact cttacaattc
41701  aaccataaaa tgacaagcca attaaaaaac atacaaatga gttaactgac atttctacaa
41761  agaagatata ccaatggcca atatgcatgt taaaagatgc tcaacatcac tagccatgag
41821  ggaaatgtaa atcaaaatca caatgagata ctagtacatg cccactagga tggcaatgat
41881  aataataata ataataataa tgttattata atgaacaata caagtgttag taaggaaatg
41941  gagaaaattg aacccaacta ttatattgct ggtgtgaatg tgaaatggtg gtactgtttt
42001  gaaagatgat ttggaagttc ctcagaaagt taacaaaagt taccatatgg tctggcaatt
42061  ctacatatat acaccaaaga aaactggaaa taagattca tacaaaaatc tgtacaaaaa
42121  tatctacagc agctttactt acagtatcca aaaaggggaa aaaMcccaaa tcttcatcaa
42181  ctaatgaatg gataaacaaa gatggtatat ccatacaatg gactgttact cagccataaa
42241  aaggtatgaa gtactgatag atactacaac ataaatgaaa cttaaaaaaa tacgcaaagt
42301  gaaagaagct agacagaaag ggccatatat gtgatgtgta gagaaaacat ccaatagaga
42361  caggaaatac attagtgatt gccaggggct gggtaaaggt gagagatgga gaatgattgc
42421  taattggtac agaattttt tgttgggaga gttatgaaaa tattttggaa gtataattag
42481  aattaggctg ttaaatactt taaaacaaaa aacagctggg cgcagtggct cacacctgta
42541  atcccagcac tttgggaggc cgaggcaggc agatcataag gtcaggagat caagaccatc
42601  ctgcccaaca tggtgacacc ctgtctctac tacaaacaca caaattagcc aggcgtgttg
42661  gcgcgcctgt agtcccagct attcggagg ctgaggcagg agaatcactt gaacctggga
42721  ggcagaggtt gcagtgagcc cagatggtgc cactgcactc cagcctgggc gacaagagca
42781  aaaactccat ctcaaaacaa aacaaaacaa aaaacaaaag taagaagtaa aaaaatagaa
42841  ttagactggg gatggttatt gagccttgtg aataatctaa aacccactga attgtatatt
42901  ttagacagtg aatttgatgg catgttaatt atatcttgat gttttaaaaa aagtagtaca
42961  gtgtctgaaa ggtagcattg gccatttgaa tctctgttaa cattttcttg ggtggccatc
43021  agattttga ttaaaggtga ccttggcaat taagtggtgg gggaacaca accaaaaggg
43081  acaaaccaac acaaccacac acaatcacac aaccctctcca cctccaccac agtggaaatc
43141  aagcataggt gcttccaggg actgtgaaaa tgtggccaca gttgttttcc cagcaaacca
43201  ttttctttca caatatcccc aatttgcaca tcccccactg agctgaaatc agtataactc
43261  gacagacgaa agtcagcagg ggtaacctac ctttgatatt attttgttgt tccatcaata
43321  atttacttat ttctgaaaac caacagtctc tgatttcttt tgaagctgcc tgcaatcaca
43381  cataagaaca cactataaga ctaccatgag tattaattgc agagttttta ttctcccagt
43441  gaccgttaga ctaatgagat agaaaacact tgtcaagtca tgggaacaca ataaggaaag
43501  agtagaggag acccatgggg aaggcatgag cgttacctgc aggatgtatt tctcaagtcc
43561  atttcgactg gcaatctcaa actttctatg gctccccctt ccaagctggc gaattgaaag
43621  tgtcatcagc tattataaag agggaagaga aatgttctat accatcgttt tctgatttta
43681  aaatagtccc tgtcaatcac tctaatcctt tctatccttg acagctctct tctttcatct
43741  tcctttcaag ttttttgcttt cctctcttaa tgactccaag acagcataaa acacaatctg
43801  gtacagtgtc ttctgtctca tctgtttcag aaggtaacac agactgttaa ctttctactg
43861  tatctttatg caggaggcgc tgcagccctc aacctttcag tgaagagatc atttctcctt
43921  caacRtgtat tttacaactt tctacgtaat agtaactgaa taaggatcta ttcagaaaca
43981  taaataacaa ggccaggtat ggtggctcat gcctctgtaa tcagtcctgt aattccagca
44041  ctttgggagg cctaggtggg cggatcacct gaggtcagga gttcgagacc agcctgacca
44101  acatggtgaa accctgtctc tactaaaaat acaaaattag ctgggcatgc tggtgcgtgc
44161  ctgtaatccc agctacctgg gaggctgagg cagaattgct tgaaccggg aggtggaggt
44221  tgcagttagc caagatcatg ccattgcact ccagcctggg caacaagagc aaaactctgt
44281  cgaaagaaaa gaaagaaaga aagacaagaa agaaagacag aaagaaagaa aggaaggaag
44341  gaaggaagga aggaaggaag gaaggaagga aggaaggaag gaaggaaggg agggaggggag
44401  ggaggaagga agggagggag gaaggaagga aggaagggga gaaagaaaac aaaggctact
```

FIGURE 3-M

```
44461    atgaacaaat taacagcttt aatcacaaca gcataaatat atatgggtgt ggctcctgta
44521    tgtgggtgtg tgtgtttcat agcctgagag ctaactggct atgaaacagt ttctaaacag
44581    gtgagaaaac aatgcttggt gtgggcctgg gtgccttaga ccccaaggtc aggacaatgc
44641    ctgcacttag acacaaagat acaccgttga gaaggacaag tctaagatga aatccagccc
44701    atgttctcat cactaagtct ttcaactctc ttttacctct ttgcctggaa gaaagagggt
44761    acttttacta attagtttgt ccagactggc tgccatatag tctttttct  ctagtacaaa
44821    ggcactccta tgccagccct ggcccataag ctctgaccct ggagtcagac agacccggct
44881    atggattcta gccctgtggt gtggtatttg gcaagttaac ttcacctctc tacactgcag
44941    cttcctcatc tgtaaaataa ggaaaacgat ctctctcttt tctgcatagg gcgactccca
45001    gatgcaatag gactcccttt accttcatgg Ycttcttgaa gctgtaatga ggagataatc
45061    cctggtcccc aggctccatt cgtatcttac agaacactat tccctttca  aataggtaga
45121    tttgcctctg gctgggttta aatcgaatca aatccttcat tttataacga tccttgtgaa
45181    ttgtccagac gctgaagggg ccgtgcagca acagcttgcc tagttttcca atatcgtcct
45241    tttggaaaca cacatacagg aaaagaagct gtaaaattac ttgacagaga aagaagcctt
45301    tgtggcctgt tttcaaattt tataaagcat gcttctttga ggtttacaat tctaaaagtg
45361    ctattcaggc tggtctgtca ctaaatcaaa acgacaattt tttgagcttc actgagcgtg
45421    gtgccattta gttatataag gaaatcaatt cagctatgaa aggtaatgct atacataaag
45481    aatgttagaa atgcttgagc tagagatacg gggactgtga tattttgac  tcaattttaa
45541    ctagcagaat tcaatttcct ctgtgctatg tttgatacat gacagtctcc ttcaaaggga
45601    caagaaatta acatttcaat tatgtccagt agagatagaa ttttggctgc attgYggacc
45661    catgacgatc tgtgtgttcc atctgcatcc taacttctgc ttcaggtata tgaggacctg
45721    agaaaatgaa gcttgttctg aaaagagaaa gtttactgtg atctaatctt cacaacattg
45781    taatggaaat agtaactgca ttcaactctg agtttttcag agtgagtcaa cagtgccaag
45841    ataataccaa atgacagatt tttaagaagt ctgtttgact ctaggcataa actgtgatgc
45901    ccctgtctcc accagcaagg ctgcctttgt catatgtctg gttgaaagtc caaatgagat
45961    gaccctgcct tctctgagct ctcttcaaaa gacagtggac caagatgagc tgggagcgag
46021    gcattttatc tggtattttt caaaacttcg attgcttaaa gcagataaga attcatttcc
46081    ctgaataaaa acaccaaaag gaacaaatta tttgaagggg accaagacaa agaaatctcc
46141    ctaagtgacc tctagctgag atcaatccct atgatttctg agttaatact ggaaatatgt
46201    acttcattca taattgattg ggcatttta  taatttattg tttatatgtt gggcaaactc
46261    taggtatctt ttttaaaaag gaattgactt tacttctgaa acattaaaag aaaaacttca
46321    agagcaataa actctagtca tttctatggt gtctatggcg ttatttccta tgttaatttt
46381    ctatttcttt ctttggaaaa tttacatatg tagactgtgg tgaataaaac cctcaaactc
46441    ccagccacga ggccttcttt cctaaaagcc aatgctcctg ttctgtgtta acagttcacc
46501    acattccaaa acagaagggt ggataggtcc atgaggaccc tggagaattt tttcactcta
46561    tctgcatcca tcaaggaccc actcaaatgt aatcactaca gaccttagtg actgcttttt
46621    cctttaaatc cattcaattc ataatcaata tcgacataaa tagtgcagga aatatgtttt
46681    agtaaaggca actggtagaa gtagatactt aatatttgcc acataaacaa atgttatcag
46741    cacaggttga gcatccataa tttaaaaaat ctgaaatcct ccaaaatctg gaactttctg
46801    agaaccagta tgacactgga ggtgaaaaat tccatacctg accacatgtg atgggtggca
46861    gtcaaaacac agtcaaaatt ttgcttcacg cacaaaatta ttttttattt ttattttt
46921    tgagacggag tcttactctg ttgccaaggc tgcagtagag tggcacgacc ttggctcacc
46981    gcaacctctg tctcctgagt tcaagggact ctcctgcctc atcctcccga gtagcttgga
47041    ttacaggcgt gcattaccat gcccggctaa ttttttgtatt tttagtagag ccagggtttc
47101    agcatgttgg ccaggctggt ctcgaactcc tgacctctgg tgatctgccc acctcagcct
47161    cccaaagtgc tgggattaca ggcataagcc actgctcccg gccttcatgc actaaattat
47221    ttaaaatatg taaaattacc ttcagtctat gtgtataagg tgtcatgaaa cataaatgaa
47281    tttcgtgttt acacttgggt tccatctgca acataactca gtacgatgc  aaatactcca
47341    atcctccct  aaaaaaaaa  aaactccaaa acactttggg cctcaagcat tttggctaag
47401    ggatattcaa acttgtagtt tctatcttac aatgtattca ctctctacct cattttaaac
47461    attcgacgca tcttacagaa atatatacag tatagacaga tagaaaataa ccgagggaat
47521    taaggtgaag aaaaaataaa gaagttggga gcttggcgcc tgcctgtagt cgcaactact
47581    tgggaggctg aggcaggagg atcacttgag tccaggagtt tgaggccagc tgggcaaca
47641    tagggagatc accatcccta aatataaaga caataaatca gatgaactgt tccagaaggt
47701    gtagaagata aagaaaaga  tgaagaggtt atatgtaaaa tgcatataat aaagccattt
47761    aaacttgatg taaacttggc tctgactttc taatagcaat acagaggaa  acatggtgag
47821    tggtacgatt tattatgtct gaagacatac acaaaccggt tgttcaggaa aagcacagct
47881    attcctacta agacataaga aacatttctc ccagtgatat gttgtcactg agcaacatcc
47941    tcaaccacgc cctatgatag aaagaggaac atgtttagg  taaagctgct tgtaagaaca
48001    catttggtca gtgtggaggc tcagctgtca aagtaattct agaagaggct aggatgatag
48061    gggaaggggg aataagtcga ggtgtacact ctctaatgac ttgtgaagat ggggtgacgt
48121    gagttaaggc atccacaagg ctattgtaga ggaaacagcc ccaaccagaa atgctgaaga
```

FIGURE 3-N

```
48181      ggcagcctca ggcagcaagg tttgtgcttt attacctctg aactttcctc atcacccat
48241      ccacagccat gctgctgcac cttcataggc aagtaatcag aggatgtgaa tccagagagg
48301      taccagcagc tgaccatagg gcccccagca taaaaacaat gtgccagggK tgggggttgg
48361      caatgtgatc tctccctgaa ctgaagaaaa caggaggaag tggtgaccag caggagaYgg
48421      ggctgtgaga tgctttaggg gaaagcaggc agtggaataa acgagaagga aacagaacta
48481      tgaagaaggt gagtcattag aaattatgag gaagaggaag aaactgacgg aagggaaaaa
48541      aacagtcagt aggtggtaag agSgggggcg agcaggcatg tgggtgcact tgacatatac
48601      aggcgggtca cacaggtaag aaccccggct ccctcccag gcccaggccc cagaggtgct
48661      gtggatcctg ggtttgctca gttcccatct ccgcgaactt ggctttgcca tcgtgacttc
48721      ttgagaagct gcaggtcagc tttccagtaa gcccattatt actggaagtg actcgggggg
48781      agtcgctggg tctttcaagt ctggcagaaa catatgggca catatcctct gggtcatgtt
48841      gcacaaatgt tctcaggacc acacatatga cggtattgcc catctccacg cccaaggtcc
48901      gatctccagc gggtgagcac atgccctaca cggtgctgac caagggcagg cacacacact
48961      gttcactgtg ctgtgtggag ctgctccgcc tcaacagga agctgcaggg acattccctg
49021      agcaggagca agaatgacct tttccgtcac gtgtacctttc tctttccaac tagactgtag
49081      ttgatctcaa ggtcggagac cacgttgcac aacctctttc agatacgtgt tcaccagtat
49141      ttatttattt attggcattc cctagtattt atttatttat tggcatttag tggtgcttgg
49201      gagtaggggga caggaaacaa aatactcatc actgtgaggg aatattgatt tatccaagga
49261      gttcattcag cgacgcccct gtactgggtt gaatagtgtt cccccaaaaa ctcatgtcta
49321      tgagaccctc aaaatatgat cttattcgga aagagggtct ttgcagatac aattggttaa
49381      gatgggggttg ccctgggtta ggatgggtcc aaatccaatg actggtatcc ttataaaaaa
49441      agaaaacaaa gaaatggaga cgcacgctga gggaacagcc atgcaaggc agaggcagaa
49501      attggagtgg cacagctgtc agccaaggaa ctccaagaat tgccggcagt caccagaagc
49561      tcagacgagg taaggaagga ttcttcctga gagccctcag agggaacgtg ggcctgctct
49621      caccttgcct ttggacgtct agccgtcaaa actgtgaggg aataaatttc tgttgtttta
49681      agtcacgtac tttgtggttc cttcgacat cagccctagg aaacgaatat acttccaact
49741      gttttccacc agtaacaaag aagtgtggcc atgtcacacg gtgtgtggaa gaacctgatg
49801      gttgtgaact cagagatgga acatagcggc tacctcaaat gagcgagcga taagttagat
49861      ggcctcctct gtacaagaag tgatagcaaa atcaattagt aaatgctacc actttcacac
49921      ctgggcattc tgcaggtaga agcccgcgata caaggatttc aaatgtgact acattggcca
49981      aatgaagagt ctggctgaga gagtgaatct agggaagctg gcctcagcaa gagcttcttt
50041      tgggtgcccg tgtttccatt ccaggtagta agagttaata tgactgtcac aaacttactg
50101      cacaaagaag caggaaacat ctgtataaat gcgtccacac agagcctgag tccagaaatg
50161      aaaagcagaa gctgtgggag cctgtgatta caatagtcag gggcaaagag gtatcttcct
50221      ttccagcttg agcaggtccc catataacgt accactaggg ctgtttattc ggcatctgtt
50281      gggcgccagg cacagtgctt ggtgccttac ccatcattta attctcactt actcccggca
50341      accgcctgta atataggtat tgtggggggg tgggggggt ggggggtgg ggaatgaaga
50401      agatactttg cctgggtcac taggattatt tacttagccc tatctctgca gctaacactg
50461      tggtaaggaa agaggaaact gaaatagaaa taaaatcctg gccctagctc acaatgaact
50521      tacaatacaa gtacatcctt tagtggttta tataaatttg ttccaaaaag gaagactgtt
50581      tcattcaatc tttacaagtc aactttggaa cttatccctg gcaagtcaga atttaaatgc
50641      atctctaata tgcattggat ttgaaaaaaa aaaaacaaact tgttttttt ttgcaaatag
50701      atagaagtaa attataactc agtgttccac aaaacaaact tgtttggaaa agaattttaa
50761      acttctgtga ttaaattaga cccaggacta attgagtaca cagaaaaaca agaaaatata
50821      aatatcagaa gggattttt tctagttgct ttctagttgt ttaattgtga taatttaatt
50881      atcacattca atttctttcc tttataaaac caggttaata ttaaatttca agcagagaaa
50941      ctaagaggtt aaactggact cagccatgca tatagctgta atttattaca ggtgatcata
51001      aacacctgta ataaaactct acaaaatgga gacaaagaat ctcagaatca tttgagctga
51061      gttagaggca gttgtcagtc aattctaatc agaaacagat aaagagtgga atagcaccct
51121      gataggggaat gaacaagaaa tagtccaagg tgacagccat gtaatcttga gtgagttaac
51181      tcttctttcc atggatcttc ttttgaatca gaaggttgaa aattccaata tctactcctc
51241      cataattcaa caggattata caaaactgtc aggagaaatt agctgatgta ttagatgtaa
51301      aagtaagtta agtcttagta gaaaaggtac caaaaagcat ctggcagagg cacaattctg
51361      aggacacatg gtcaaaaaag gtcctttgct ttttgcgtgt aaaatctcca aattctgtaa
51421      gctggttcat cctatttgca tgcaaactgg ctgggaatga aattaggca gaatgttatt
51481      tgctcatgtt ttaaccattc ttttctcaca gcctcctcct cctatgttat ttacactgtt
51541      tcctgccctg tgtattgttt ccaggacatt cattagattc agggaaatga aatttaatag
51601      ggatgtctaa tacgtaattc aagatttaaa aaggaacaga aagatgccct ggattgacct
51661      aacaaattgt tcccttgact ttcctcaggc gaagaaagaa gaattattac caagaaaatg
51721      atccttatac acaccctaac cctactctgc agtttatgca tatcctcttg aatcatgcat
51781      cagttgtcat cagagacacc ttggagtccc aggggacagt aacagcatca tggctgggat
51841      cacagcaaac cccatggggc taagtttctg agatccaggc ccaagaaata ccagcgtggg
```

FIGURE 3-O

```
51901   aagtaaaaat aactcatttt tcggaccttc ataactttca tggtttgatt tatgacaagg
51961   aaagaaaagt catttcctct accaagacct caatacatgg tatgttcaaa accaaataaa
52021   aatgaaaaga aaaaaaaaga gaaggaaaaa gtataatata atcacaagtg acaaaaacgc
52081   agaagagggg gtcacagaga tgtgatgtaa gaaaaacttg gccgggcacg atggctctca
52141   cctgtaatcc cagcactttg ggaggcggag atggtggat cacgaggtca ggagttcgag
52201   accagcctga ccaacatgga gaagccccgt ctctactaaa aatacaaaaa aaaaaaaaaa
52261   ttagcaaggt gtggtggcaa gtgcctgtag tcccagctac tcaggaggct gggacaggag
52321   aatcgcttga acctggcggg cagaggttgc agtgagctga gatcatgcca ttacactcca
52381   gcctgggcga cagagcaaga ctctgtctca aaacaaaca aacaaaaaga agaagaaccc
52441   aacctgccat tgctggtttg tgctttatta cctctgctca tagaagccat gagccatgga
52501   gcgtgggtgg ccttttaag ctggaaaatt ccaggagaca gatgctagac tccaaaaagg
52561   aaaggaaaca ccttgatttt agcccatgag actgtgttga acttctgacc ttggaacttc
52621   aaaataataa taataatgaa tttgtgctgc tctaagccac caagcttatg gtaatttatt
52681   atgacagtga aataaaacaa acacatctga ataaaaatct agagtacttc aaagtaaaaa
52741   acaaaacaag tcgaatatta actatgctcc agtctcaaag agatcataca gttatagggg
52801   atgttttgcc tggaatgcct gggaccagcc tgctccggat taacactgac gctggagctc
52861   aactccccag cattggcctc taactgcatc tcttgggttt tctttagact atttggatta
52921   atgcatgtac actatatact tttggggcct cttctggat ctgtgatata aaattggggc
52981   aagaatatag gacctgtttc caaaatactt ttcttagaga aactctgaaa caagaagaca
53041   aatcttttac tatttaata gtgccatgag ttagaaaata aattgctcct ccaggacttt
53101   tcctctgccc atatatgttc tggcccttga cttctggtt tgtccagaca gtgggtcagt
53161   cccacattca gaaccctgag gaataaatYc aagattcctg aagatgccaa gggacagctt
53221   ggaatcttgt agtgcgggtt tactgagcaa tttaggcgac tgtcctcaga gtccaattcc
53281   tttaccatag acgatctctc tgactttgcc agagcatttc ctcactgtgt agtattgcac
53341   ctgccttttg tgtgagatgc tctaacacta ctatggaaca taccggacat tcagtcactg
53401   ctgctaggtc cacagccaac tcacaggact tgatcaaatc ctctatcact gccaaagctt
53461   gttgtagttc agttgagaat gctgaatctt tggttctctt tggcccatcc tgtggaaaac
53521   aaatgccttg ttggaaatca aagtatacc atctgcaaag tgaagaagga aaacaggaca
53581   gagatgagga gccagggatc cagccaaccc tgactgagaa gggtggatat tgatctgtct
53641   ccctgctccc aaagcatggt ggctaaagat gcttactgat ttaggtatac ggcatagaga
53701   caagcaaaat catctacctc tgtgcattgt actagtgacg aatgaagttc ataaatcatg
53761   gaaattatat tcctgctaca taagaaacat atagaattca gctatatagc tgaattctat
53821   atgtttctta tgtgtatata tattatataa atatttatat agtatattaa atatttatat
53881   attaatatat aattatatgt ttatatatta attatatata ttaaatattt atatatttata
53941   tattatataa aatataagta tatatattat atatatatat atatatatat atatatttt
54001   tttttttttt tttttttttt tttttttttt tgagagcgag agagagtttc actctgtcac
54061   ccaggctgga gtgcagaggc acgatctcgg ctcgctgcaa cctctgcctc ctggattcaa
54121   gcaattctcc tgtctcagcc tcccgagtag ctgggattac aggtgtgcgc caccatgcct
54181   ggctaatttt tgtatttta gtagagacgg agtttcgcca tgttgaccag gctgttctca
54241   aactcctaac ctcaggtgat ccaccacct tggcctccta aagtgctggg attacaggcg
54301   taagccactg tgcctggcca gaattagct tttttaaagc atggaaaaac ctagctcctt
54361   ttaaataggc ttctctctct tttataccc tattccctgg ggcttactga aaaaaaaaat
54421   accatatggc cgggcgggtg gctcatgcct gtaatcccag cactttggga ggctgagaca
54481   ggcagagcac ttgaggtcag gagtttgagc ccagcctggc taacatggtg aaaccccgtc
54541   tctactaaaa atacaaaaat tagcttagtg tggtggtggg cgcctgtaat cccagctact
54601   tgggaggttg aggcaggaga acagcttgaa cccaggaggc ggaggttgca gtgagcccag
54661   attgtgtcat tgcactccag cctgggtaac aagagtgaaa ccccgtctca aaaaaaaaaa
54721   aaaaaaaaaa aaaaaagta gctgggtgtg gtggtgtgtg cctgtaatcc cagctactca
54781   ggaggctgag gcaggaggat tgcttgaaca cgggaggtgg agtttgcagt gagccaagat
54841   tgcgccactg cactccagcc tgggcaacaa agtgagacct tgtctcacaa aaaagaaaa
54901   aagaaaaaga aaagaatac aatctgagta tcatattcct atatttaatg tggaagcctt
54961   attcctgtgg gaaaattat acttaaaatc atcccagagg aggacatttg taaactccta
55021   tagagacaaa gaactccata gaggctgcta agtggaaatt tactaatgat ttacatgtaa
55081   aagctataac atcatatttc cacactgaat ctcccaac tctgtccttc cttcctccac
55141   ttgtccctgg ccctccccac attgcaccac cattaaagat gccaaagaga taagccagcg
55201   ctctgcacct cccgaacata aagactcagc attcagcgga aaagcagtaa ctaattaaag
55261   agaccaatgt tccaattaca accacagtga catttaggat gtgattgggg tgattgtttc
55321   agctctaaag gcttttgcat gggcttgagg tatttatct ccctgctacc tacatgctgt
55381   atttatctgt tacctggtaa atacacataa aaaaatttg gtttattcaa tgtatttttt
55441   taacatctca agttctgcag tgaagaacag ctagccccct tgctgctccg catctggccc
55501   tgactctttt tgtcctctac agcacaatgt agtcacaggg tttaatattt tcttaatcta
55561   tgcggaagca ctgggtattt gcatctttgg atgagagaca tgagtgacag ggctgatgaa
```

FIGURE 3-P

```
55621  tggaatagat cgtgctgctg cctctgaaaa acgtatcatg gattcgtagc ttctcattca
55681  taataaagaa gcttcgcttc ctggtaaaag aaaacagact ctcacctgaa tttattttaa
55741  caacatcaat aagggattaa gagttcttgg cagggcgcag tggctcacgc ctgtaatccc
55801  agcactttgg gaggccgagg gggggagtgg atcacgaggt cacgagatcg agaccagcct
55861  gaccaacgtg gtgaaacccc atctctacta aaaacaaaaa ttagccgggc gtggtggcgg
55921  gtgcctgtaa tcccagctac tcaggaggct gaggcaggat aatagcttga acccgggagg
55981  cggagttgca gtgagccgaa actgcgccat tgcactccag tctgggtgac agagcgagac
56041  tctgtctcaa aaaataaaa aataagaaa taattttttt ttaaagttct tataccaggc
56101  atcttcctcc ttaccaaaca ctgaatgctc agtttccttt cagatcctca cctcttccca
56161  tccccttcc ttccgctaac cctccttcac aaaacacgag gtggctaggg ttttgaactg
56221  tataatgtag ggttcagaaa atcctttaa aacattatta aactcctcta actagggcta
56281  gctcctcttg ctccaggctg taaaaatatg acctgtgtcc tgagctgctt ctgttttcaa
56341  caggtccttg tcatccattc tgagcagaaa gggcatgcaa atgactgccc cataagacat
56401  gtctcaagtg tttcttgcta aaaccagaat attctatagg aaagggaaga gaaaccgcac
56461  tgctataMca cagatttctt cctaacctgg tgtggtcatg gtcacctttt attctaaggg
56521  aactttggca gactcttaga gttcacacac acgcacacac acacacagag gagaacaagg
56581  cataacatat agaaattaga tatactaaga ggtaataaga agaaaacata atcctaccat
56641  tcaggaaagc cacagcagac attttatcat atctatttac ttccagtctt ttatgtatgc
56701  attttacgta tttgcttaat tttgttccca ttaaaatttt tttggctggg tgcagtggct
56761  cacgcctgta ataccagcac tttgggaggc cgaggcaggt ggatcatctg aggtcaggag
56821  ttcaagacca gcctggccaa catggcgaaa ccccgtctct actaaaaata aaaaattag
56881  ctgtgcatgg tggcgggcac ctgtaatccc agctacttgg gaggctgagg caggagaatc
56941  gcttgaaccc gggaggcaga ggttgcagtg agccaagatt gcaccattgc actccagcct
57001  gtgcaatgga gtgagacttt gtctaaaaaa aaaaaatta tgtggaagga agaaaatata
57061  ttaccacttc catttgggct gcaaatccct actttaaaat tgcctttaat tttttttgttt
57121  ttttttcttga ctgtgagtta taggatacat actattttag aaaatctaga taataaagac
57181  caccaagtaa aattgctata aatcctccga cccatagaca aacaccatta atagttagtt
57241  atataaaatg taatatttaa tattgagtac cttagccgag cctcctagtt cacctgggtc
57301  tatctccata tcttcaggag actcgaaatc cagcagaccc tgcattaacc caaaagtctt
57361  gttgaaaatt aaaatgtaca ttgccatcaa aatgtagatt gtcaacaaaa tctactgtgc
57421  aaactatctg ccaccaatgc taagctgact gagaacgtgt gtaaatgtgt aagagggaaa
57481  gaataaatga tgtatttggc acagggtcct ttccacaaac ctagaatcat attgtacaca
57541  ctattttgta gactactttt tctcattcaa ccatacctca tgaatatttt cccatgatat
57601  tatgtttttc taaaatatgg gctttgattg tggtagagtg ttatatctta cagataaacc
57661  attttttctca ttcagcaata tctcatgaat attttcccat gatattatgt ttttctaaaa
57721  tatgggcttt gattgtggta gagtgttata tcttagagat aaaccatttt tctcattcaa
57781  caatatctca tgaatatttt cccatgatat tatttttt taaaacatgg gctttggttg
57841  tggtagagtg ttatatctta tagataaacc ataatcgaat tatagtcccc cttatcatta
57901  aacatttagg ttcaacaata ttttttacta taatatgat aataacttt gtgcattttt
57961  cttaaagcta aattcctaga gtggaattgt aaatgttaag agtttgagg catatttcca
58021  agttcttcag agaaggactg tcttcctgcc agctgtatag gaaagcctgt ctcaccagcc
58081  cctagcctac aaggggtagt accatttaat caaaatcctt taccaattga atgaaaagag
58141  aaatcctacc tcactgttgt tttaatttga cttccttaga taactagagg tgtagaactt
58201  ttttaaaaaa acgtttgcta ctagtgttta ttcttttgca aattgctatg tcctttgcgc
58261  atcttttat tataattttcc aagagcacat gattcattaa gcatactgat catctgttac
58321  atattttgtt cacattttcc ccaatgtttc atgagtctgt ctttaatggt ataagctatc
58381  actcatcacc ctctccccaa gatcccatga tcctttctaa agcatgaggc aatcagtcca
58441  acattcatgc tcttcaagc cagcacatgt gtgcgagatg caaaataagc tctgccctg
58501  gggatagaga aggtcctaga taggattaca aggtcgttcc tttctttgca ggcacgtaat
58561  ggcctgagct ggtttcacag gcaccagcaa gcttagctgt ggggacactg ctctggtctg
58621  ccttgggtag ctcccacggc tcctcacaga ccccccgcaa atattttgt agtaattcta
58681  tctcttgttt cttcagtgaa aggcagctaa caaaaccttc taagtccttt taacctgtat
58741  tatctcattt aatgctccca acaagcatac caggaaagta ctattattat cttatttcta
58801  taggtgagaa atctgaggct gagagaggtt aagtaacttg cctgagttca cgcagcctgg
58861  aagggtcaga gcctggattc agaccaggt tgttaaactc tcgagtctgt gtttccaatg
58921  acgatgcccc acagccctct gcgtctgcta ccgaacctag ctcctatgta aatgtcacct
58981  ctgtgggaaa gctgaaacct aggctgaggg aggaaggacc atcactttcg tcctgctcat
59041  gcctcactgg gcccagaggt tggacttcta caataggaat gacagtgaca atgggacatg
59101  cagaggagca tgaggccctg agtgagtgct gggtcaaaca tgctctgagg tgctgctcgc
59161  tgaaagaagc agatcattat cctcattctct atggtggtgt gacagtctca atgtctaaga
59221  taacagctac acatcatgca gagcttcctg ggctgtgcca agccctccgc atgtgctaat
59281  catctgcttc ataacgatct tatggaggag gttctagtac cctcatttta catagaggaa
```

FIGURE 3-Q

```
59341    aactaaggcc caagaggKca aggtctcata actgacaaat ggcagagtac accgaggctg
59401    aaactgctaa tggaaagctt gaaaggagta actttgaaaa aatgttttta aaattatttt
59461    tacagatgag gtcttgctat gttgcccagg ctagtcttga actcctggac tgaagggatg
59521    cctcctgcct ccacctcctg agtagctgct gggactacag gtgtgtgtta tcatgtctgg
59581    cctgaaaggg gtaactttt  ctgaggggag actgttgggc aatgagctta accttcctga
59641    gcctcagttt cttcacagtc cagagcatgg ctggtatgtc tgattgtgga gattaaataa
59701    gaaatactgt aatcccagca ctttgggagg ctgaggtggg cagatcacga ggtcaggagt
59761    tcaagaccag cctggccaac atggtgaaac cccgtctcta ctaaaaatac aaaaattagc
59821    caggcatggc ggcgcgtgcc tgtaatctca gctacttggg aggctgaggc aggagaattg
59881    cttgaacctg ggaggcagag gttgcagtga actgagatcg cgccattgca ctccagccta
59941    ggcagagtct cactctgtct caaaaaaaaa gaaagaaaga agaaaaaag  aaatacacgt
60001    ggggaagtac ccagtaaaca gtaggtgctt gttttttgttt tgtttttgt  ttttattaa
60061    gaaatagtgg ccactgggca agagctacct aaatgcctta tagaggttaa ttcaacagac
60121    aacttatcgt ggtggcccaa acctttctct caagctcaca cctagaaaac cagccatgat
60181    aggccctcat atcctgtttg gagtgtctga gaatgcttgc ctgcagatgt gctagtgtca
60241    atgacttatc actaaggagg ggtaaaggtc agagagagag agagaaaacc acttaggggt
60301    tcaggggttca gatatagcaa agttcattct gttaggctgc tctcagggta agatcctaaa
60361    tctaagaatg gaggtcagtg ctgcaaaagg ataagaagact tcagtttgt  cttctccctt
60421    ccacaagtta aaatgcccat aaaacagtaa cttttgggaa aatcacactc tcgctcccaa
60481    agagctctct tccctaagc  cagactcctt agtgattcat gccctgagct agacattgga
60541    ctagtgaggc cctcaggtgc cctccaactc tatgattctt tggtcttact ccacattgaa
60601    gagggctgat ttagagttgg aggaaagaaa aagcctgcag gatagacgta tcttcagcct
60661    tagaagacca aggcacagct ctacatgtgt aacgacatgg gcaccacagt gcaggcgtct
60721    ggtttcccac caaggaaaag cactgtctca ttgattttac cttcaacagc atctggtatt
60781    ttataagtct ctggcttggt cctttgagat acttaaaaag agggagattg tgatccagtt
60841    ggcgctggca tacctttaaa agccaaatag aaacaacata agcaaaaca  aacaacacac
60901    acagaataaa agtggcagca tttaggtaca aaacacaaaa ttgcttttcc tggacaacag
60961    gggcagctgt gtcgagcagc tccataaggc tgtgggttg  ttctttcccc taggaacagt
61021    gtgtgaaata agagaaagag gaaagaggac ggctcggcta atattttac  aggcatctag
61081    ggaagcagaa ccatttatt  cttttagaaa gcaagttcac tagaagacag tggggcattt
61141    caagtccttc tgaaaaagag gccacctatc ttcaagttgg gggctgccag agtctattca
61201    ggccttttgg agcctgaagg atacagacgg tttgtagaca tcattccagg gagcccaaag
61261    tgtgacattt tttacttagt ttcattttta aaacccatct tagaagaaga cactggtttt
61321    ctcaccagat ataggtgctc ctcacaggcc tatcccatta caacttttca tgtgtaattt
61381    caaagtatgg gacactttaa ataaacataa atcgcaatgc caagttcctc tccctagtcc
61441    cacttttgat ttctttaaca acttgatgca tagaaacatt ttccaggaag aagtttgtct
61501    tctcaacatt accccaaagt aggcgcagtc ttgacactct tgccagattg ccctagctcg
61561    gggcagattc ttatggtatt taaaatatat ctgaagatct tctttctagg tgggaaaaaa
61621    ttagaataaa ttaatcaggc agcattttc  agtaagtgga caggatgata cagtttattc
61681    attcattcaa caagccagag tattctaatg tgtaaggaat tgggggtgta cagtaagtaa
61741    tcttatgttg ggatgtgtgt gtgatggaga gataaacaga aggctttaaa caaccataac
61801    taccagacat agataggcac agagtgctct gggagcatct acaagggcta ttggtaaata
61861    cataagtaga ctcacaaaca ggaattggtt tttatctttta tcattctttt cctgcccttt
61921    gtccaggaca tcgacatctc cccacacag  gtctgcaatg agtagtaaaa ctgacagaaa
61981    agaggctggt gtttgatggt cccctctct  tctctctcca cctctcctt  gtggtcatcg
62041    tgacaccaac cctgcaaaga agcccaagaa acaaccaaaa gatggaaaca tgccagaggg
62101    gagatgtggt agatcgggca accaatacgg agctcagtca tttgggcaac cctcaaagtg
62161    acaggctccg cctcaaacat cactttcaac ctgcagcaca agactctgag acaggaaatg
62221    ttatgtgact gtttcggagc tagagagcaa ggaggactca acgtgctgtt caacctgtat
62281    tctcatggta tcaaagacgc tgagaggtgg gcacatatct gccaatctcc cggagagaaa
62341    gcacactcca agcctctggc gtcagcttgc cagcttcact cgctctatca gggagcctgg
62401    cccacagcgg ctgtgctggc cacagatccc atgccattct ggtggagaag cccatgtagc
62461    cacctccttg cagaagtctg tgtccctgtc ctcctgctca gcccaactct ggatttcctt
62521    catgtcaaca cagatgattc cttccctctc agcttcaatg atgcctgttc tactcccaaa
62581    tacattgcta tagtggatga cttccatttc tgtagctctt tctttctccc aataggttgt
62641    aagtggtcat ttcagctatag gaactacagc aaccgtcctt tgctattccc tccaggaaaa
62701    aaatggcaca cacatttaag acagatggcc cttgaaaaat gttcagactg gttaaggagc
62761    tagaataata actcagagct taacaatata gtattgacct aaattgctct tctaaaggct
62821    aacagtccaa aattcctcag agaaaggatg tccactaacc agcaacatac aaaagtgccc
62881    aattctccta atctccttat agaatgaatc aggaggctat aaaattgcta ccagaaactc
62941    atattcacac aagaatacat acttgcttac ggattaagac tgcggggctc tggtggcgga
63001    tggtccaggt tcagttcttg gctttgccaa atacaaatca tatggcctaa agtaagttac
```

FIGURE 3-R

```
63061    ctaaccttcc tagacttcag tttcctcatc tgttaagtgg gcccataaca gtagtcaact
63121    cctgtgactg ttgtgagatt aaatgagatg atgtatagaa acctctccac aaatgcccaa
63181    tggatagagt actcaaaaaa tggtggctat tgtcaaagca cttttactt tatggaatcc
63241    tctgcatacà ttattttgtt tcccacaaca actgtacata ttggtactat tagcctgttg
63301    tgtggaggag gaaagtgaga ttccaaagtt taagttattt actggaggtc atgcagatag
63361    caagtggctt gaccaacatg ataaatcggg tttcctgact taccagttac tcccacatat
63421    cagtgtgagc acccattcca gtgctctttc cattttacca tgtgagatct cagagtactt
63481    ggaacccaca gtacactatg gacaaatatt attctatata gaacatggtc tctggaggag
63541    aattgtttca gaagatacag gctaaagagg ctgattaaaa cacttggtca gaaaactatt
63601    tcaaaattca ttatcttgga aggccgaggt gggcggatca cgaggtcagg agatggagac
63661    catcctggcc aacatgatga aacctcgtct ctactaaaaa tacaaaaatt agccgggcgt
63721    ggtggcacat gcctgtaatc ccagctacga gggagggtga Rgcaggagaa tcgcttgaat
63781    cagggagtca gaggttgcag tgagccgaga tcacgccaca gcactccagc ctggtgacag
63841    agcgagactc cgtctcaaga aaaaaaaaaa aagtactact tgtattttgt ctctaacatc
63901    ataaatcaca tagggctaag tcagtgtttt ctggctggt taatgattta caatgttcct
63961    cccaacatgg cggggcgcta tcaaaaaact ttgtaaaact ttacaattta ggagaggaat
64021    tcagaaaagg tatttagtta ataattctct gacaatttcc tcatattga acaatttgat
64081    aatatccact ttcccacagg aactttgccc atttctcatt gagcaattta aataatcttt
64141    gcagtaatga catacataac cataaaatac ttctaatctc tgaaactaga tttcacatta
64201    gtcgtttgtt aagtgcaaaa attcaaaata gtatataaag cactaataat gtaatagttc
64261    aaaaaaatta atgaatcaga atgagtataa aatagttttc agtgtacatt gaattctggt
64321    gctttgacac aaagcctatg atgagttgac atggaaagcc atatgggcc accaaaaggc
64381    tctgagcatg gaagattcct tctctccatt aatgtcaaat atcttgaaac ctggaggctt
64441    tgtttgcttc cagtatcat aagtattgct ctcagcctca gtcataatat gagttgctta
64501    caactttaag ttgtttgatc tgttgccttg ggttcacaaa aataaaaata agaaagagaa
64561    tgagaaggac tagttgagaa agagaggaga aatgagaact atttagaagg cacagggggt
64621    caggatcatc tccatggtcg tgtcctagaa agtacctggt ggggattgat gttgggtgga
64681    acatttctct gtggcagctc ccactggccc atatagccta tttgttgcct aaaacagggt
64741    ggagaaacag ggaaagaggg aagaagtctg ggaggtggga agaagggta gttggaggta
64801    taatgttgta ggccaagatg ttcataaatt gagtactaag cctaaaggag gctgtagatt
64861    tagaattttc gaatcatcct ctatgttgta aaaaatagaa tggaaagaaa atgtatttcc
64921    tgaggttttt agtttaacac cagtgcttct cctcttgaga gcattagtac agctttattg
64981    tgggactcta acctcgctgt atgattcttg ttttaaaacg tagttgagtc attcagaaga
65041    ggatcctctg ctttggggac catggatggc cagccttcca tttcatgggg ctttgcagga
65101    agccaggctt gcggttactc ccacatatca gtgtgagctc agtcaaattg gactcattct
65161    caccttggat aaagtcagat aaagttggga ggccaactca tgttttccat tcaaagggca
65221    gatacaagat atactgtctt gacaaattgc aagtgtacag tacagtatta ttccatgata
65281    gtcgccatgc tgtgcgttac atctccagga cttactcatc tcataactgc aagtttgtac
65341    cctgtgacca acatctccct acttcctcta gactccagcc cctggcaacc acccttctac
65401    ttcaatgagc tcaactgttt ttggattata tatatataca tatacacaca cacacacaca
65461    caatggtaat gaatgtattc attaacttga ttgcagtaat catttcacag ggtgtaagta
65521    tatcaaacca tcatgttgta tagtttgaat atatgcaatt tttatttacc aattatactt
65581    cagtaaagct tggagtcgga gggaagcaga tatgttttta gaccattgat gtttccattt
65641    gtccttgcca cttaacgcag aaatgtaagg gctgacttta acatgattat ttactgggag
65701    tacagactta ctctccttgag aaagcaatgt gccagaagtt cagggttctc agcacacttt
65761    tccaactctt ttagaaaagt cctagaaaaa taaagtata caagtaataa tgttttgatt
65821    ttgacatgta ggtaattaat ttttaagta caatcacata aggtttcaag aggtgcctag
65881    aaaaatgttc tccaggcctt cttgctctta tcttctacac attgattcag Raaaaaaagc
65941    tgtattctga ggtattacta caattaccct gaaatcactc acaactttaa gttgttcgat
66001    ctgttgcctt aggttcacaa aaagaaaaat aagaaagaga atgagaagaa ctagttggga
66061    aagagaggag aaatgagaac tactcagaag gcacagggggg tcaggatcat ctccaattat
66121    cagaacacag ctgttcgggt aattctaagc actagtcata gatagactgg atacattcac
66181    tgatgctctc tcttacatga agtaacgtt cataagaact gctgctgctg ctgttgctat
66241    tactaatatc attgacagct tactataagc caggcataag ctaagtgctc cgcaaatagt
66301    atctcattta atcctcaacc aaagataggg ttttataaat ataaaacctg gggctcaaag
66361    aggctacata acttctctgg ggaaatcaac agaaatgggt ttccatttca gttttgcgtc
66421    tgaccaacgg acgaggaatg gggttaggaa gcaactgtgg ttcaattcac caagcagctt
66481    ttctcccctct gtgaattagg tgtgcaatct tggggtcatc atagcgaata aagagagtta
66541    acaagttacc attccatat gtgtaacatg aaagggtttg aagatgattt ccaaagtccc
66601    ttattcctgc aattctctag aactcaatat ccaagcagcc ccgagttaaa agtacaactt
66661    gtttgagcag tcagcatttt ctaacaccct agttcccagc atcccttat gatagtagta
66721    tggagatgtg tatcttggtc atctttgtat tcccaatgct gagcacagtg cctggcacag
```

FIGURE 3-S

```
66781    aacaggtgct caaaaaatgc tgatgcatga ataaataaac aaaggaacac tcaactgcat
66841    acaacatgga tgtctgacac tgggtccctg ttcctttgat gtctcttccc tttctctcca
66901    gggatcctgt ggggcttctc ccctcctttc actccaaccc accccaatcc aatccactga
66961    ctccaaacca cttgcttaaa cctgaaaaca tctaagtgtt ttcatctctc aattccatca
67021    gtctcatttc caccettctS ttactctcca ttctttctga taacatgaat tattatatac
67081    ctgttgtgaa attcgtaaag ttctctaata ttcccaaaga gaaagtcctt gttattctga
67141    agaacatctg gaattagatg ctttagccaa ataaaatcca ttggagtgat atatccctgc
67201    agaggtgcaa acaaggtagg tgttacaaac aggaacatac cagagatcat ctgaattagc
67261    tactgcaaaa cccaaaactt tagtgaaatg attgaagaat atagcacact tgtttcttga
67321    aagctatcgt attgagtact ttctttttgat atcattttcc tcatgtgccc actttcagaa
67381    ggagatggct taatggcaat gatcataaaa tggcattttt gtgggaagaa caaatatatt
67441    taaaaatgtt tatgttacac aggtttaatc taaagaagg gaaaatgtac ccactgtttt
67501    atgaactaat acaattacta ttattattat gattattatt aatattgaga cgaagttttg
67561    ctcttcttcc caggctggag tgcaatggcg tgatctcggc tcactgcaac ctccgcctcc
67621    tgggttcaag tgattcttcc gttcagact cccaagtagc tggaattaca ggcacacacc
67681    accacacctg gctaattttc gtatttttag tagagacagg gtttcaccat gttggccagg
67741    ctggtctcaa acttctgacc tcaggcgatc cacccgcctc ggcctcccaa aatgctggga
67801    ttacaggcgt gagccactgc atccggccca ataattattt tttaatatct gaataatgtt
67861    tactcagcat atatatcata gttactaaa cattccctt ttatggacat ttggttgct
67921    tctaatattt tatggtaaaa atgtgattat aaataatcgc gtacatataa ttttttcctt
67981    aagattattc ccttaggaaa atagggaaaa catgcatttt tactcttaag aaaaagacta
68041    ctttaaaaaa acaagaaata atcttccctt attaaagtat caggaacact tataatatcc
68101    tttgttggca agaagatggt aaacctattt gggctttgct ggaatcagtg tgaactggct
68161    taattctttg gaaactattt ggctacatgg atcaagaaac cacagggatg ttcttattcc
68221    tactggagac acttgtaata ttctaagacc tgaaaccttg gtgggaattc tggagacttc
68281    tggcaactat tttgagtctc tttgtacaac aaaacatctg cagtttgaat atatgcttga
68341    taccccactc cccaaatcta cttacatcaa ttatgctttt aatctctttt atgtaaatct
68401    cttcagtctc aagcaagtca cgtataatgc gcctgaatca cagcagcagg tgggagggtg
68461    aaagagagag agacagggag aggagaatgt tctttttagaa ttctgttaga ataatgctca
68521    tcaatacagt tccctttag tggctcacct acttagtttc tggtcagttc attctgttct
68581    attgaacacc caaggtcagc atctcacaaa cgcacactgt gatcacactg gtatcaagaa
68641    gaaacagcaa ggttagagaa ctcaaaatcc tttaggcagc cagtgaatga cctgtcctct
68701    gggtgggcca tatagtgtgg gggtcaagaa gggagatgtt ggagtcagaa ataccaggtc
68761    tggatcctta gtcaaggaag gtctgcctga ccccaccccc acccctata ttgtatacat
68821    tgtataagtg gtttcctaga ttttctctcc agctttctgc tcacatcaag ctttcttttc
68881    cttttaagag aaagggtctt gccctgttgc ccaggaatga gtgcagtggc atgatcatgg
68941    ctcactgtag ccttgaactc ccgggctcca gcaaccctcc tgcctcagcc tcccaagtag
69001    ctagggctac agatatgcac catcacaccc agctaacgcc ttttttttttt tttggtagag
69061    atgaggtctt gctatgttac ccaggctggt ctcaaactgc tactttcaag caatcctcct
69121    gcctttgcct cccaaactgc tgggattata ggtgtgagac actgtgccag gccagatcca
69181    gatctttgac ccatatggat gtattttgtt gtacatgggg ttagatgtat gctagctcct
69241    tcctctggca ttggatgttt cactgtgatt tcctaaggca aaagatatga ctttctgtctg
69301    cttctgtcaa ggaatgcagg tggaagatgt ggtggacaga atttaagacg gtccccaaga
69361    cttctggccc cactgcacat acgcctcttc caatcaaaca ctaatttagg ggatgctgtg
69421    gaaggatttt gctgttcatt tgataggtaa tccagttggg cctgtcctaa tcatatgaac
69481    tcagatctat Mtgggtcaag tggtcagaga ctggaagcat aaaaaagatt caacacaaag
69541    gagattcccc tttgctgact tttgagatgg aggggccag atggaatgga atgtgggcag
69601    ccgtaggaac tgagagtggc tcccagctga caggcagcaa ggaagggaaa tcagtcctat
69661    agttgcaagg aaccgagtcc tgccacaacc acgcgaactt agaagaggat ccagagctcc
69721    acatgaaaac acagccagcc aacaccttga ctttagcctt gtgggactcc tgtcccaggg
69781    aaactgtagg tctcctaagt ttgtggtcag ttttttatata gcaatagaaa accagtagaa
69841    agagtaaggc cagtccccac atctatccca gacagacttt cttttctctcc tcaggctacg
69901    tggccatatt tattatttct tttaggagtc caagtagatg agtgtttata catgtgtcct
69961    tgtgtagaat atatatattt attcttgtta actattgatg gattatctat taaatggcag
70021    cctctcctag aaaatgattt gttttctct cataaaaatg gatgtgacaa atgatccaat
70081    agaaaaaaat gggaaggac acaaaatagg agattcacac aaatattcaa atggatatga
70141    gactcgtgga aaaaatactc agtacataca ttcaacgaag gcatatttta aaagagcaac
70201    aatttcatc tattagaata ttaaacattt caaacctcat agaaagactg gtaaatgagg
70261    gtgtggaaaa accctcacac aatattggta aaatgtgtaa atttgtgcaa gctctttgga
70321    aggtaattta gaaacatctc acccaaatgt aaaacacgtg ctccttggtt cagtaatttc
70381    acttctagga atgttcattg tttataatta ggacaatata acttcaacaa caaccagata
70441    taaactggtt acttaaatgc tcatcaaaaa attatggtac atgggccggg catggtggtt
```

FIGURE 3-T

```
70501    cacccctgta atcccagcac tctgggaggc tgaggcaggt ggatcacttg aggccaggaa
70561    atcgagacca gcctggccaa catggtgaaa ccctgtgtct actaaaaata caaaaaatta
70621    gatgggtgtg gtagcgcatg cttgtaatcc cagctacttg ggagggtgac gcaggataat
70681    tactcgaacc caggaggtgg agattgcagt gagccgagat cacaccattg cactccagcc
70741    tgggcaacaa gagtgaaact ccatctcaaa aaaaaaatat atatatacat acatatagat
70801    atagatagat atatgtgtgt gtgtgtgtat atatatatac atatatatgg tacatacata
70861    taatgatgaa ataccatgca attgttaaaa agaatgaggc tgactaaaac actgatatga
70921    cagaggccag gtattttag tgaaaaaaca aaacaagacg tagacaagta agcatagtat
70981    gactatttgt gtaaaaaatg aatgtgtatg tagaaatata cgtaaaactg tatatgctca
71041    gaaaatttat gcaagaaac ttaacacatt gttaaaagtg attgcttttg gagagtggta
71101    ctgaaagcta aagtatggga aaggagaatt tctacatctt actctatacc cttctacaat
71161    cttttttaaa gtgaaacatt tactgctttt ataatggaaa aatagggttt acataatatt
71221    ttaaaatgaa tgttactgga ggtaatgata tgtaaaccct atttgataga tataaataaa
71281    taatacaatt cacatatttt acagctcatt attctttctt ataatcattt ttgtgtctat
71341    ttataaatac ttgtataaga caagactgat aaacaagatg taccacagag gatgtaattt
71401    ccggaagtct aaaactccca aaaagttact taaacatcat actttactaa gtcactgaga
71461    aagaggttcc tatgcctttt ataaatcacc cggaaacaac aacggtttct atgtcagaag
71521    gaagtacagg cctcaatacc aatatgtttc tacgagccct ggcatcaagt gggaccacag
71581    caacagttaa gcattcatgg aaaacctgag tacaatcagc ctcttatgcc ttcatgaagc
71641    actgggctta agcaacttgg caagctggct tcaggatgca ttgacaatta aaggaagtca
71701    gaaggcagaa ataaccagga ggtggacaga agtcaaggtt attatccaaa aatgatctat
71761    gaacttaaga gactcttagg agcttttagg actctaatac aggaaaatat tcacatctct
71821    gaaggaaaag aaatcccttg gtcatattct ggattacagt ttggaaaaaa agtctagaaa
71881    tctcatccaa ctgcttcatt ttacctgttg gagtgcaaga gataaaatgc caaggatagg
71941    aactccactg aagaatgtag gcaaatcaat attcattaaa tacattcaaa ttaatatatg
72001    acttaaaaag agccctcaca tcagtgttag gccattgctt ttccttgctt ctcttgtttt
72061    cctttcaaat acctttataa aataggagaa aatgtatgac tcttttttttt ttttttttt
72121    ttttattata ctctaagttt tagggtacat gtgcacattg tgcaggttag ttacatatgt
72181    atacatgtgc catgctggtg cgctgcaccc actaatgtgt catctagcat taggtatatc
72241    tcccaatgct atccctcccc tctcccccga ccccaccaca gtccccagag tgtgatattc
72301    cccttcctgt gtccatgtga tctcattgtt caattcccac ctatgagtga gaatatgcgg
72361    tgtttggttt tttgttcttg cgatagttta ctgagaatga tggtttccaa tttcatccat
72421    gtccctacaa aggatatgaa ctcatcattt tttatggctg catagtattc catggtgtat
72481    atgtgccaca ttttcttaat ccagtctatc attgttggac atttgggttg gttccaagtc
72541    tttgctattg tgaatagtgc cacaataaac atacgtgtgc atgtgtcttt atagcagcat
72601    gatttataat ccttgggta tatacccagt aatgggatgg ctgggtcaaa tggtatttct
72661    agttctagat ccctgaggaa tcgccacact gacttccaca atggttgaac tagtttacag
72721    tcccaccaac agtgtaaaag tgttcctatt tctccgcatc ctctccagca cctgttgttt
72781    cctgactttt taatgattgc cattctaact ggtgtgagat gatatctcat aatggtttg
72841    atttgcatt ctctgatggc cagtgatgat gagcatttct tcatgtgttt tttggctgca
72901    taaatgtctt cttttgagaa gtgtctgttc atgtccttcg cccacttttt gatggggttg
72961    tttgtttttt tcttgtaaat ttgtttgagt tcattgtaga ttctggatat tagcccttg
73021    tcagatgagt aggttgcgaa aattttctcc catgttgtaa gttgcctgtt cactctgatg
73081    gtagtttctt ctgctgtgca gaagctctt agtttaatta gatcccattt gtcaattttg
73141    tcttttgttg ccattgcttt tggtgttttg gacatgaagt ccttgcccac gcctatgtcc
73201    tgaatggtaa tgcctaggtt ttcttctagg gttttatgg ttttaggttt aacgtttaaa
73261    tctttaatcc atcttgaatt gattttgta taggtgtaa ggaagggatc cagtttcagc
73321    tttctacata tggctagcca gttttcccag caccattat taaataggga atcctttccc
73381    cattgcttgt ttttctcagg tttgtcaaag atcagatagt tgtagatatg cggcattatt
73441    tctgagggct ctgttctgtt ccattgatct atatctctgt tttggtacca gtaccatgct
73501    gttttggtta ctgtagccttt gtagtatagt ttgaagtcag gtagtgtgat gcctccagct
73561    ttgttctttt ggcttaggat tgacttggcg atgcgggctc ttttttggtt ccatatgaac
73621    tttaaagtag ttttttccaa ttctgtgaag aaagtcattg gtagcttgat ggggatggca
73681    ttgaatctgt aaattacctt gggcagtatg gccattttca cgatattgat tcttcctacc
73741    catgagcatg gaatgttctt ccatttgttt gtgtcctctt ttatttcctt gagcagtggt
73801    ttgtagttct ccttgaagag gtccttcaca gttcctgtaa gttggattcc taggtatttt
73861    attctctttg aagcaattgt gaatgggagt tcacccatga tttggctctc tgtttgtctg
73921    ttgttggtgt ataagaatgc ttgtgatttt tgtacattga ttttgtatcc tgagactttg
73981    ctgaagttgc ttatcagctt aaggagattt gggctgaga cgatgggtt ttctagataa
74041    acaatcatgt cgtctgcaaa cagggacaat ttgacttcct cttttcctaa ttgaatacct
74101    tttatttcct tctcctgcct gattgccctg gccagaactt ccaacactat gttgaatagg
74161    agcggtgaga gagggcatcc ctgtcttgtg ccagttttca aagggaatgc ttccagtttt
```

FIGURE 3-U

```
74221    tgcccattca gtatgatatt ggctgtgggt ttgtcataga tagctcttat tattttgaaa
74281    tacgtcccat caatacctaa tttattgaga gttttagca tgaagggttg ttgaattttg
74341    tcaaaggctt tttctgcatc tattgagata atcatgtggt ttttgtcttt ggctctgttt
74401    atatgctgga ttacatttat tgatttgcgt atattgaacc agccttgcat cccagggatg
74461    aagcccactt gatcatggtg gataagcttt ttgatgtgct gctggattcg gtttgccagt
74521    attttattga ggattttttgc atcaatgttc atcaaggata ttggtctaaa attctctttt
74581    ttggttgtgt ctctgcccgg ctttggtatc agaatgatgc tggcctcata aaatgagtta
74641    gggaggattc cctctttttc tattgattgg aatagtttca gaaggaatgg taccagttcc
74701    tccttgtacc tctggtagaa ttcggctgtg aatccatctg gtcctggact cttttggtt
74761    ggtaaactat tgattattgc cacaatttca gagcctgtta ttggtctatt cagagattca
74821    acttcttcct ggtttagtct tgggagagtg tatgtgtcga ggaatgtatc catttcttct
74881    agattttcta gtttatttgc gtagaggtgt ttgtagtatt ctctgatggt agtttgtatt
74941    tctgtgggat cggtggtgat atccccttta tcatttttta ttgtgtctat ttgattcttc
75001    tctctttttt tctttattag tcttgctagc ggtctatcaa ttttgttgat cctttcgaaa
75061    aaccagctcc tggattcatt gatttttga agggtttttt gtgtctctat ttccttcagt
75121    tctgctctga ttttagttat ttcttgcctt ctgctagctt ttgaatgtgt ttgctcttgc
75181    ttttctagtt cttttaattg tgatgttagg gtgtcaattt tggatctttc ctgctttctc
75241    ttgtaggcat ttagtgctat aaatttccct ctacacactg ctttgaatgc gtcccagaga
75301    ttctggtatg tggtgtcttt gttctcgttg gtttcaaaga acatctttat ttctgccttc
75361    atttcgttat gtacccagta gtcattcagg agcaggttgt tcagtttcca tgtagttgag
75421    cggctttgag tgagattctt aatcctgagt tctagtttga ttgcactgtg gtctgagaga
75481    tagtttgtta taatttctgt tcttttacat ttgctgagga gagctttact tccaactatg
75541    tggtcaattt tggaattccc tgctttatta ttctaaagca agcttgtcca acctgcggcc
75601    tgtggcccaa cacaaatttg taaactttct taaaacgtta tgagattttt tttgcgattt
75661    tttttttttt ttttttttagc tcaccagcta tcgttagtgt taatgtattt tttgttttgt
75721    tttgttttga gacggagtct tgctttgttg ccaggctgga atgcagtggt gcagtctcgg
75781    ctcactgcca cctctgcctc ccaggttcaa gcaattcccc tgcctcagac tcccgagtag
75841    ctgggactgc aggcgtgcgc caccatgccc agctaacttt ttgtatttt gtagagatgg
75901    ggttttacca tgttggccag gatggtcttg atctcctgac ctcgtgatcc accctccttg
75961    gtctcccaaa gtgctgggat tacaggcgtg agccacctcg cctggccagt gttaatgtat
76021    tttatgtgtg gcccaagaca attcttcttc ttccagcgtg gcccaggaaa gccaaaagat
76081    tggacacccc tgttccaaag catgtaattt tattcacaga aaagactctc ggccgggcgc
76141    ggtggctcac gcctgtaatc ccagcacttt ggaggccga ggcaggcgga tcacgaggtc
76201    aggagatgta gaccatcctg gctaacacgg tgaaaccccg tctctactaa aaatacaaaa
76261    aattagccag gcgtggtggt gggtgcctgt agtcccagct actcgggagg ctgagacagg
76321    agaatggcgt ggaccccgga ggtggagctt gcagcgagcc gagatcacac cactgcactc
76381    cagtctgggc aacagagcga tatccgtctc aaaaaaaaaa aaaaaaaaa aaagactctc
76441    aaggatttac catctaaaat catcaagtgt atatcatgca gatgaacaac agaaaacact
76501    gggagtattc aagtaattaa aaataacctt tcagcaccaa cagcaatttc tgtcctgatg
76561    gcaatctact cagagctaga ggactgcact taggatacca aagggagctt aggatgcaag
76621    agcagcctgc actaatgtac tctgcgttag tttacatccg ggcactttgc tttacgtttc
76681    aaaacagacg ccgcccttag ctcattaaag gggaaatgga ggtataatgt gttttaaagg
76741    gatgtttctt ctctgaagcc atatttcagg gtagcatgaa acagagctt tggatatctg
76801    gttccattct acatgacacc tcatgcttgt ttcaaatgac accacaacca aggggcagga
76861    atgaaaggaa tatgctaaaa aaaaaaatg caatccttt tagcaagaaa gatcattaag
76921    gatttcctga taagttttctt ctttgttcat gtgccctcct ctgctccccc tttgaactac
76981    tgcccctgtc accccccctt cccgcctcc ccgccgtttc tcagttctcc aatagggatc
77041    cagtctgcca gaggtctatt tttgctcatt attgtcaaca caatttgcca tcaagagttt
77101    tcacttactc ctgctatcct atcatcacat tatgcatgtc agaaagcatt acagattttt
77161    acttttcaag aacccgaact cagatttcca ggcttctgtc cttcctgttt catgctgttg
77221    actctcccac atctttgtct tcctcctaga cctttggtca ctcttgagcc cacattgcca
77281    atggtctata tcattttcac ctggatgcct cccagacacc tcagtcacat caagttgaaa
77341    tagaactaat tagacagaag tagcatgtgt ttcagtggaa ctgacatttt tctagggtcc
77401    ctaaaacaca ggtgttgttt caaactcccc cctccaacat cccttatatt ctctctgtca
77461    cccaggctcc ttatatcatc tctcaacatg cttcctgggt gactactgac tctccacttc
77521    tggtgacacc ccacagagca agctttcaat tcctgtcatt taaacacttt agtgcactca
77581    tagaatctca tccttctgag atttctcttc caccagtcta ttttgcagac caccaggcta
77641    cgcccttcca aaagctccctt tgagatggag tttcactctt gttgcccagg ctggagtgca
77701    atggcatgat ctcggctcat tgcaactgcc acctctcagg ttcaaatggt tctcgtgcct
77761    cagcctcccc agtagctggg gttaaagttg cctgccacca tacccagcta aattttgtat
77821    tagggttttt accatgttgg ccaggctggt ctcgaactcc tgacctcagg tgatctgcca
77881    cctaggcctc ccaaagtgct gggattacag gtgtgagaaa ccacgcctag tcccccaaag
```

FIGURE 3-V

```
77941    ctccattttt  atcctgtctt  cattctctct  tcaagaactt  gcccacagct  gccagagttc
78001    cttctaagag  tttaagactc  tctgttcatg  tggtaagaat  cttcttaagg  agcttgcttt
78061    aaaggtaaaa  ccagatttac  acatcagaat  ggggagaggt  gggtgggagc  taagatggaa
78121    tctgtaattt  tcacaagtgc  cctggatgat  tctactgcag  atggtctcct  attcaactaa
78181    atagcactca  tctgacccac  tcctttaga   ccccacttct  gttaagccag  tgttatcgct
78241    attttccact  ttctttcaag  ttctaatcat  ccttaaaact  ccaacagctt  cagctgaaat
78301    cagtaccaca  ctctcatcct  tgtttcccac  ccaaaaacta  ttgtactaat  tgaccagaca
78361    tgtattgatg  ccctactatg  agcctggctc  catgataggc  acttgggata  gagaaatgta
78421    ccataatcct  gaccttaata  aatttagagt  ctaatggaag  agataaaaaa  aatcaatgat
78481    tccaatgagt  gtgataaggt  aaggctagtc  agaaaagtca  ggtgcagagg  aggggcaact
78541    aattaaacca  ggggttgggg  gagacactgc  caactctgtg  ttgagtgaag  tttaagcaga
78601    ggtttttctt  taagtaaaaa  atcagttttt  ttaaataaaa  agttttttaa  aaagtaaggg
78661    ggaatagaag  aaggaggttt  gtccctaagg  gaacagtgt   ggaggaggaa  aggaggtgaa
78721    agtgtatgct  attctgtgta  ctggcaaatt  ctttggtggg  tgatatggtt  tggctctgtg
78781    tccccaccca  aatctcacct  tgaattgtaa  taatccccac  atgtcatggg  agggacccag
78841    tggaaagtaa  ttgaatcatg  agggcaggtt  tttcctgtgc  tgttctcatg  atagtgaata
78901    agtctcagga  gatctgatga  ttttataaag  ggcggttccc  ttgcacatgc  tctcttgcct
78961    gccaccatgt  aagacatgct  tttgctcctc  ctttgcctcc  caccatgatt  ttgaggcctc
79021    cccagctatg  tggaactgtg  agtccattaa  acctctttcc  tttataaatt  acccagtctc
79081    agctatgtct  ttattaggag  catgagaata  gactaataca  gtaaattggt  actggtagag
79141    tggggtgctg  cagtatctga  aaatgtggaa  gcaactttgg  aactgggtaa  caggcagagg
79201    ttgaaacagt  ttggagggct  cagaagacag  gaagatgtgg  taaagtttgg  aacttcctag
79261    agacttgttg  aatggctttg  accaaaatgc  tgatagtgat  atgggcaata  aagtccaggc
79321    tgaggtggtc  tcagatagag  atgaggaact  tgttgggaat  tggagcaaag  gagactcttg
79381    ctatgtttta  gcaaagagcc  tggcagcatt  ttgcccctgc  cctagagatc  tgtggaaatt
79441    tgaacttgag  agagatgatt  cagggcacct  ggcagaagac  acttctaagc  agcaaagcat
79501    tcaagatgtc  acttgagtgc  tgttaaaagc  attcagtttt  atgtattcac  aaagatatgg
79561    ttcggaattg  gaacttatgc  tcaaaaggga  agaagagcat  aaaagttcag  aaaattggca
79621    gcctgatgat  gtgatagaaa  agaaaaaccc  attttctgag  gagaaattca  agcctgctgc
79681    agacatttgc  ataagtaaga  tggagccaaa  tgttaatcac  caagacaaag  gggaaaatgt
79741    ctgcagggca  tgtcaaggac  ctttgtggca  acccctccca  tcacaggctc  aggcctagga
79801    ggaaaaagtg  gttttgtggg  cccagccagg  ggaccccgtgc  tctatgcagt  ctagggactt
79861    gttgccctgc  atgccagttg  ctccagccat  ggctgaaagg  ggccaaggta  cagctcaggc
79921    cattggttca  gagatgcaag  cctcaagcct  tggtggctta  cacgtagtgt  tgggcctgtg
79981    ggttcacaga  agtcaagaat  tgaggtggat  gtacagaaat  gcctggatgt  ccaggcagaa
80041    gtttgctgca  ggggtggggc  cctcatggag  aatctctgct  aggggagtat  ggaagggaaa
80101    tgtggggctg  gagtccccac  acagagtgcc  cactgggaca  ctgcttggtg  gagctgtgag
80161    aagagggaca  ccatcctcca  gactccagaa  tggtggatcc  accaacagtt  tgcaccatgt
80221    gcttggaaaa  gctgcagata  cccaacacca  gcccatcaaa  gcaaccacaa  gggggctgt
80281    accctgcaaa  gccacagggg  cagagttgcc  caaggctgtg  gtgggaaccc  acctcttgaa
80341    tctctatgag  acatggagtc  aaaggagatt  attttggaac  tttaaggttt  gactgcttta
80401    ttggatttca  gactcgcata  aggctgatag  ccccttgtt   ttggacaatt  tctcccattt
80461    tgaacaggta  ttttaccca   atgtctacac  ccacatttta  tctgggaaat  agctaacttg
80521    cttttgattt  tacaggcaca  taggtggaag  ggacttgcct  tgtttcagat  gagactttga
80581    actgtggact  tttgagttaa  tgctgaaata  agtctttggg  ggactgttgg  gaaggcatga
80641    tttgtcttga  aatgtgagga  catgagattt  gggaggggcc  ggggtgaaat  gatatgtttt
80701    gtctctgtgt  ccccagcttc  atcaggatcc  tcccacacat  cccattcta   agttgcaggg
80761    tcccattctt  ttccaatcaa  tgccctcatt  ttaacagtag  acacctggtg  aggctgtgca
80821    tgcacctttc  attgcaggtc  agccgctccc  atgataagag  cttgtatctg  attttccaca
80881    atttcagctc  tttctctaca  agagataaga  ctctcactct  ggacaatctt  agaagatttg
80941    aggctcagtg  tatgcttctg  gagctgggag  ttagaatccc  taagttcatg  gttttcttct
81001    atcagtttgt  ccagtgaact  taggagcaac  caaccaactt  cgttatattc  cttggtcctc
81061    tatatatggt  caaaggtatt  atgtatagag  tcattaaact  ccttgcctct  catgagtggt
81121    gaatcaggag  tactgaatgc  atttctttg   cataagtgtt  tgaacagttc  gtgccaagga
81181    ctatcagtgt  tctccacaca  attagaagta  gagtccttag  catttgggg   tctaatcata
81241    ttaagcaacc  aactccagaa  acccaaaaac  caactaaaga  atctatcct   tctgtaatcc
81301    cagcactttg  ggaggccaag  gcaggcggat  cacgaggtca  ggagactgag  accacagtga
81361    aaccccatct  ctgctaaaaa  tacaaaaaat  tagccaggca  tggtggcggg  cacctgtagt
81421    cccagctact  cgggaggctg  aggcaggaga  atggcatgaa  tccaggaggc  ggagcttgca
81481    gtgagctgag  attgcgccac  tgcactccag  cccgggtgac  agagtgagac  tccagctcaa
81541    aaacaaaaaa  aaagaaaaaa  aagaaatcca  tccttaaaat  tctgttcctc  tagaaccatt
81601    cccagtacca  aaatctgatt  aaaaaaaaaa  aacaggcaga  ggaaggtgga  aggactagat
```

FIGURE 3-W

```
81661    ctttctccag tgctggatgc ttcctgccct ggaacatcag actccaagtt cttcagcttt
81721    tggactcttg gacttacaac agtaatttgc caggggctct ttggcacttg gccacagact
81781    gcaggctgca ctatcagctt ccctatttt gaggttttgg gactcagact ggcttcctga
81841    ctcctcagct tgcagatgcc tatttgtggga cttggtatct tgtgattgtg tgagtcaact
81901    ctcctaataa actccccttc atatattcat ctatcctatt agttctgtac ctttagagaa
81961    cactgactaa tgccgtgggg ttaagccaat cgtctagtag gttcataaaa tgctaaaagc
82021    agatataaac ttaaagacga tccagctcat ctcttcattt tacagatgta aaaacagaag
82081    tagaaataga attggaaccc cagtttcttg aaacccagtg tttgcataat accatgctaa
82141    tttcattcta atttgtgttt tatttaataa tcaggaaaca gttcaaatag aggcccaggg
82201    ctctgaaaca ttgcccaagg tctatggctt ttgcaaagca agtactgttt ctgctacttt
82261    acctagttgc tcttggccta tgtttggggt gcatctaaag aactgtttgc tgattattaa
82321    ataaaacaca aattagaatg aaattagcat ggtgttataa aaacacaggg tttcaagaaa
82381    ctggggttcc agttctattt ctacctctag gatacagggt aagtcacttc ctttctcaga
82441    ttctgtttct ttgtatgtca aagggctgga ttagataaac ttgacttccc ctcttggccc
82501    tcatgtatca ttctataaat atgttatcat ttctaataga ctgtttgatg taatcttttg
82561    tctaatggcc cctgcttttc acaataaatg aaacaaaggt cacaagactt ttattcattt
82621    gcaaccctga ttaactaaca gttaatgtgt aactggagtg ccacatagaa acagaaagga
82681    gaaggggaat ggattgggtt ggagaaggtg aagtctgacc tatcctctac aagaggtaca
82741    gggtttatcc aggaagacag gagtgccatg aggagtaaac tccagcaggg gctggagtca
82801    tggccacaca caggggcctta caggatccag gctgcccaga gcagagtttg gatgggggct
82861    gggaggctgg gggagctagc tgaggagatg gttgtcatgc caggccacga gtgtggatga
82921    gtgctggcca ggggaggtat aggagattga tggggctgtg gcaagcaggg cagatacccct
82981    tccaggaacc tgtttcatta aacacagaat acagtcctga gggctcggtc tcaatacagt
83041    cctgagggct cggtctcagg aaaacatgtt cttaagtttt acatccttct tctgttttga
83101    ttaggtgttt cctgattata aaataaattc ctagaactgt taatggtaac aacacaaagc
83161    actatagacc catacgagga tcatattgaa accaatgaca tttaagaata aaagatctga
83221    tgaatatgaa cacttccctg gttcctagga ggataacagt tgagttttgc tcaggtaatc
83281    tgccttctct tccttcttct ctgctttRta tctcagtttc tatattttgt cttacattaa
83341    taggatttgt tctcattacc ctgatgattt tatggtaaac tacctcaaat tcttttgga
83401    agaagatggg atataaatta tttttaaagt ttatctgaat agatgttctt caatatcaca
83461    caataaataa tgacaatgta actttgtgca tatagcactt taagagattg atcataaaca
83521    caatcctatt aatcttaatt caagttaata atgcttgcat ttgtatggca ttttaggtat
83581    tataaagttt ttttttaattg tggtaagata tgcataaaat ttactattta aacctttttg
83641    aagtgtatag ttcagtagtg ttaagtacat tcacaatgtt gtgtaaccat caccactagc
83701    catttccaga cttttcatc atcccaaact gaatctctgt acctattaaa catgacctca
83761    ttctccacct ccccacagct cctgggaacc tctattctac tttctgtatg aattttccta
83821    ttctaggtgt ctcatataag tggaatcata caatattcat ccttggtgt ctggcttatt
83881    tcacgtagcg taatgctttc aaggttcatt catgttgtag catttatcag aatttgattc
83941    atttttaagg ctgaatatct tccatttat gtgtctacca cattttgctt atccattctt
84001    ctgttgatga cacctgggt tgttttcacc tttggctat tgtgaataat gctgctatga
84061    acactgatgt gcaagtacct gtctgagtct ctgctttcaa.ttttgggcat atacctagaa
84121    gtgggattgc tggatcatag gatcattcta ttttaactt ttttgaggaa ttgccatacc
84181    acccgctaca gcagccgcat cttttatatt gccaacagtg cacaaaggct ctgatttctc
84241    cactttctgg tcaacattta gattatcatt cttttttaa aaaaacgtaa tagctaaccc
84301    aatgggcatg aagtaaggtt gttttttgttt tttgtttta atgtgtgcgt tatcttactt
84361    gatccattaa atccctaaca agaactcctc tagggcagat gtcctgtctt attcatcctt
84421    ggccccagtg tcttgcaagc aagtgaattc tcaataagtg ttaattgaat ggatggttga
84481    tagatttata ggatgcatgc caattctgtg gacgagagta ggtactaatt gttatttca
84541    tttcacagaa gagcaagtca gggctccgag cactaagtga cttggctgag gtcaaactgc
84601    ctgcaagttt tatctaatag tgacagagga accaatgtgt cgagcatgaa tgtcagtcca
84661    ttgaaacagt gcccactttt ctgactctgc tccttaagag acagggcctg tacagcaagg
84721    acacagagaa gcaggttaca gaaaagggc tggctcatcc gtgtatgcct ggcatttgag
84781    gaatgtggct gaaatctcaa cactctggtt cagaagcaca tctgcaatca aatataacaa
84841    gacatggtat gagagatgtc tggcatacca aggagattcc tagaatacag cggataggaa
84901    aacctcatta cttcaattcc caagaaagag tactactggt agtaatccca acaggagtat
84961    ccaagtaact cggtaatctt cagtaaagaa aagaaattgt gaaacaatta tagtcagtcc
85021    tccatctctg taggttccac atctgtggat tcaactcacc tcatattgaa aatattaata
85081    aataaataaa taataacaat ataacaatta aataatgca aattttaaaa gcataacaac
85141    tatttacata gtatttatat tgtattaggt attataagta atccagagat tatttaaaac
85201    atatgggaga gtgtgcatag gttatatgca aatactacac cattttacat aagagacttg
85261    ggcatctgtg gactttgtta tctgcaaggg tcctggaacc aattcccat ggatactgag
85321    ggtcaactgt accaagttga aaacaaaaca aaaggaaatc tattgcaaaa aggaaattcc
```

FIGURE 3-X

```
85381    caaagataaa aagcatgtct atgaaatagt caaagagccg aaaatgttgg gaagacccac
85441    actgctttcc ctgccctgtg cccctttttg cagatctatt tgtgtcttta tctaccagca
85501    gatattctat tattctaata gattcctgtt tttcccaaga gggtttactt atttattaaa
85561    tatgatgcaa acatctctct cagagatgtt gctctctctt cctaggattc cttagcccta
85621    aatctgcaga gccaattagg tattaatatt gggctttaca actttggacc atctgaccac
85681    caagactgat tcattaaatg tatatggttt cagatcacat taatttatca tagactttag
85741    aattggcttt ttagaagtac tgctataagg aaaatctcag catagcaagt tttatctaat
85801    agtctacttg tattaaagag tactcaatgt aaaccctagg aagactttta actgccttt
85861    ggaaattggt tgagtgggat ttgaaccgtg tactctctgt aaagcaggaa attatcactt
85921    agtaattact aagtatttaa aaatgggaaa tagaaaatta catttcagac ctggtgcagt
85981    ggctcatacc tgtaatccta cactttggc aggtggaggc aggtggatcg cttgagccca
86041    ggagttcaag accagcctgg gcaacatagt gagcaactcc atttctacta aaaataaaaa
86101    aaattatttg ggcgtgatgg ggtgcacctg tagtcccac tactcaggag gctgagacag
86161    gaagattgct tgagcctaga aggtcaagcc tgagtgagca gtgaccggcc attgtattcc
86221    agcctgagca acacagcgag accctgtctc aaaaaaatg tatattttta aaaaagaaa
86281    attacatttt agttgttcca taaatatcag tacaaccaaa cctaagtgca aaattcccaa
86341    cacaaatgat cgcctctggg ccagccatgt agcccccatc ttgctgtcaa taatcatttc
86401    caggggctgt aattgtcttc cttcccctg taccacccca tcacaggaca caaattgttt
86461    tgcttagttt agatagctgt gactaaacta agtgccaatt gtcttttaaa atatgtgtta
86521    atcagcactc aagattgttc ctacaaaaat gtcactccct cactcaattt gcatgtgccc
86581    tcctgagtag gagagaaaga gctgagttag aggcagccct ctgggacctg cacagaaccc
86641    tgtatgcttc cgggagtgtg gagtgtgtgt ctgatctgct gctgggaaaa ggagaagaaa
86701    tgctgagaca ctcactgcca ggggctggta tcaggccatt ttcacagggg ctgttggagg
86761    gttgacagca cagctctact ggaccaggga gggtcccagc cagcagggcc tgcccctccg
86821    aaactgtccc tgtccctgtc cctgagaggc cccactgagt gtcagatggc acataagaga
86881    tttccttatg cgttggtgtg aaggagatga tcagttccag gaggcccctc ccccatgcag
86941    aagagaagaa aatggaagaa accgggttct cagagtggcc tgcgggtgag tgccgccttg
87001    tgctgtcagt tcccttcacc ttccagttct gggtgtacct agtgtggttt catcaaactg
87061    ctgaggccct ggaattgagg gaggatgctg aagggtgcca ggccatagaa gcagtagcag
87121    gagctgcagc aaagagctag tgtgtctcca gcgtcagctt ttgggccttg gtggcatcaa
87181    aggagacgta cacagggcca ctgtactacg gatgggattc ttggaacaaa agtttgaata
87241    attgatgagt gtggaagtgc tatgcaaaaa ttcaattcaa cctgcagtta ccaggcattc
87301    attctgtgac aggcattatt gtgagggtgg caaggagacg gggagtctct gagagactca
87361    gagaagagca gggcatggtg tccacccaca agagatctga agactttcaa agtagttggg
87421    aaaacagaca tacaactttt ttcccctccc cacagctagt tgaggcaaaa gacatataac
87481    ttatacagtg acaaaatact actgactgtt actgacacat aacagcctgg gctgggtcac
87541    tggtgagaaa aaggaggatt cttgctttg gggcattcaa gtcctgtcca ttaaccatt
87601    cccaatccca tatttataca tcccatttta gacatattaa gctgaagatt gatgtgacat
87661    acccaaagac acttaaggtt gaagctgaga atctgggcta gaaatataaa tcaggatggg
87721    ctgggagcgg tggttcacgc ctgtagtccc agcactttgg gaggccgagg cgggcggatc
87781    acttgaagtc aggagttcaa gacctgcctg gccaacatgg tgaaacccca tctccaccaa
87841    aaatataaaa aattagccag gtgtggtggt gcatgactgt aatcccagct actcgggagg
87901    ctgaggcagg agagtcactt gaacccggga ggcagaggtt acagtgaaag gagatcgtgc
87961    cactgcactc cagcctgggt gacagagcga tacttcgttt caaaaaaaga aaaaaaaaaa
88021    aaagaaagaa atgtaagtca agattaaaga caatgggtga gatcagcaag gagcatgtgt
88081    gcggagaaga gaaccaccaag gaaggctgcg tgtggtggga ggtggccggg gggcagagaa
88141    agaggcggcg gagccaagga gatagggcat cgtctgaatg gtgatgctgt atcaacagat
88201    gtgaaattcc cagaggtgtg aaacacagca gatcctttac agcacgatga caggacacag
88261    catgagccta cctctgccag gtgagaggag ctttctgcaa cctgtgatgg gctcaaggat
88321    gctgaccatt catccgccca tgggatagc ccaggctctg agctcagcac tccacccgtc
88381    actgcgattg cactaatcct cacccaccct tgcaggcagg tattactgtg ggcacagaga
88441    agtttgctaa cttgccagag atcctgtgta ggaagccagg tcaggaaaca accagagtct
88501    ctctaacagc ccaggccttg aatgaacacc ggcctgcttc agaatacatg gcccgtgatg
88561    tgtttgaatt cacagattca ctggacaggt tccctatagg gcctgtgagg aaatctggtc
88621    taacagaatc cagaaagaca aatttcgcta acaggtcaa gcctgatact gctgctacac
88681    ttcagctgtg ttaagccact cggttatcag acctgcttct cctttcatga ttttagtaac
88741    acaggcctct tccttgggcc cctgttgctc ccaccatctc ccaggttctc ttgtactcag
88801    ggtttagtct cccctcccca ctactaatga tgcatgtgcc ttactctctg atcatcctc
88861    ctaaatctgc tactcctctg ctcttttcgt gccttatcta tccctgccga gtctaacatg
88921    cagatttgg tcattccaaa gtcatgtata gatctaatca cagggctctc tgcttaccag
88981    ctgctacttg gataaggaaa gcatgccaac acggtcctcc ttcttcatgc tggccaagtc
89041    agcatcatta ttattaccta agtttatttc taacacatct caatatcttc atgcactccc
```

FIGURE 3-Y

```
89101    tcttgataaa agtaactgag catagcacca tcaataccat caaatctgtc attctcttcc
89161    cctctctctg ggtgggacag gaagccaggc tgctctagga aatcttccct aacaagcaaa
89221    ggggacttgc ctgtcctctc gcatgtgtga tctgagcttg tgtggatccc agagtgggca
89281    ttctggacta cttgaccttg cctatctctc cttcacaccc tctcatctct ccctcctacc
89341    accaaaaaac ttgcatcgta tttccaatct ccagacatac ttttgaaacc atttatctat
89401    ctggtgtgtt tatctgtatc tagtatgatg tgaatatgtg atttgtatgt gtgtctacca
89461    ctgttttggt cagtttgtat ttctcgtggg tacagttcta tgtgctcatg tatgtggaac
89521    atatgtatac tgacacatgg acctagctcc aaatgatctg aaaggaatat aattgtaatt
89581    gaatatttgc acagatatac aacatacaca tgtgatggct gggggaaatg catgtgggat
89641    ttcagtcagc attttattag agaaggtatg tcattagtgc tgtattaaca atgaatcagc
89701    ttatttgtgg gtcactgtca atgactcctt tgcaaatcac acatgtaaat atttctgtct
89761    gtggtctgat gaacatgcag tgccacagtc tgggagatgc tgagccatgc cctgtgtagg
89821    cagcatatga aaagaactgc atgatttaaa agatgctgac cagcttaagg aaagcaattt
89881    aaaaacttcc taaaaatcta gtttgaatga acaacagttt tcattttgtg tgtgtgtttt
89941    ttcttttaga gatggggtct tgctatgttg gccacgctgg tctctaactc ctgggatcaa
90001    gcaatcctcc tgcggctcag cctcccaaag tgatgggatt acaggtgtga gccaccgtgt
-90061    ctgctggccc cactgtttta aaccctgatt cgacaatcat acatttaact cattacctgt
90121    cttgttcctt ttacgacaaa ctcaaagctt ttattttact aaagtatttg ggttaatctt
90181    ttgcttttct gtcatgttct gaaatatgta caataacaga atcgctcaaa atattatctc
90241    cgttaaatgt tttgtggctt tagggagagg tctaacaaca tgcgggaaac aagaaatcaa
90301    gcgcatccag gattcattta taatctctct cgttgagtag aagtccgcat ctctcgatat
90361    tgtctggtta cctgcatgaa gtattctaaa ggaggaaaat agctcaaaga ggacattcat
90421    gtgcactctg gcttccagtt ggccatttga gtaagtgatc gcaattaact gacgagcggc
90481    agggaaacac ttcctggaat tctcatctac agacaagaac aaactggggc ggggcccatc
90541    accttcacct acgcgccggg agggtggcgg ctggcgggcg gggccgggct cgggccgtga
90601    cgccgagagt gcggggcgcg cggctgggag cctcgcgccc ccgcccgggc ccgcccccat
90661    cccgcccgca tacagccccg catcccgccgg ggaagcgagc ccagtccagc gctgcccgtc
90721    cagtcctcgc ccaagattta aagcccgcaa gttttgttct tgagaccagc gactttagct
90781    ccgatgcggg aaggaaagcc gacctccgat ttggacattt aaagagctgg gcttgaactt
90841    cgtgagtttc gctctaaact gcccttgaaa tgaagctgga cttggaggta aagtcactgg
90901    gaagctggcc tggggcgggg tttccccctc ttctcgtatt ttagaaacgg acagcggcag
90961    tgcagcccta gtttgctgta agtttcctta ctttgttact gaggccccca gagctccacg
91021    cataagtggt gtgaccagaa accttttaac aagacccgcc tgagcctgcg ttagagctcc
91081    cgctcggaaa gtaaaagacc atcctaatcc gcggcgctgc ggaaccggtg tcccgtgtgg
91141    gaggaaccgc ggcgttccct gggcgtaggg cccgcgaggc cagcacagtc cgcctcttgg
91201    cggagcgccc tgggccggtg gttccgcgcg gagttagtct gtggtcagtt acgtggtgaa
91261    aacacggctg tgccgcggcc gcatctttcc gcggccgagg cctctctggg tgggagtgtt
91321    ggcttccttt ccggatcgct aaatggggaa agttctggcc gctcggcggg atacgtctcc
91381    aggccacgga tggttcgttc tccgtgccgc ggccccgagc tgggctccct gggtctccag
91441    cgcgggctcc cggcattggg ggctgcgggc cggcccctcc gccccgcccc cgccccgccg
91501    cgcctcctcg gccgagcggc tcgcggtctc cggcgcggga ggctccgagt ctgcccactc
91561    cgggccgagc gaggtctctg gaggagaaga gtggcgagga ggtgagggca cgccggccct
91621    cgcccggcgg gtggcgccag gacttcaggt gggaacgcgc gcttgggccg ggggcgcgtg
91681    gctggcgtgg acaccggatc ggggcccgcc gcctggccc ggaccgcgca cggcccagcg
91741    ccggaagtc gggaagccgg ggaggcctct ccaccgcgg gccccggcag ccgcccctct
91801    gaaagcgcgg cggagaagga ggctcgtccc ctccccggaa cgcctttgtt ccctccggcc
91861    tgcccgcgcg ggtggccagc ggctgggacc caggccgggc cgccgcccag gtgcggcagg
91921    taggctcggg ggccgggcag ctccggttgg ggcggcttcc cggggcctgc gggtccccgt
91981    ccctgaggag ctccggctcc tcgtggcgg acaggcccg tgcgcgggag ccgcgaggcg
92041    aacgccgcgc ccaccaattc ggttgccggc cggggcccc aggcttgcgg ccacccgcct
92101    ccggctggag ggctgaattc gagtcgaaag cccgtgtcgg gctggaaaga agaaaccgcc
92161    aacctgagaa cgctttcggc gagttactgg cggggggaaat ggggacaggg aagtgggcag
92221    gcggggagac tgcagccgca gatctccctg gcggggaggt cgtggccact cttttccttg
92281    actctgcctc atttcatttt gaatcctgat gtgacagagg caattgcttg cttggatacc
92341    ataggtaa aagtaacagt tttcaactcg actcttgact acaccctgta cattcttggc
92401    cggtgttggt tttcttaggt tatggatcat gttaaaggta caccgatgtg gtaaccgcac
92461    agtggccgat ggtggcctga ggctcatatt tatggtaatt atctgatgaa agtacatcca
92521    tcagaattgg atttgtgcgt ctgtgccttt attttgggaa accttgcctg ttccctgtgg
92581    gggatgggag aggaatgtga aaagccgaag ttgacccaga aaaggatgat tgaaggtagt
92641    tgtattaagt ggtggcaccg aaatgattcc accctgaact ttctgaaagg gtgattagtg
92701    atcagcagca gacgttataa cttttctcaaa ataaatttat ggtagatttt ctatctggtc
92761    acaagtgagg aggtgaaagc tgcttttttgg ggccaactct ttgcttttaa agcaagctaa
```

FIGURE 3-Z

```
92821  acgcaatacc agaaaggttt ccattctgta cttaacctgc ttgtccttct cactcttcct
92881  tatcctcccg cacacgctct gagcattgac tgagcactct gaggaggagg ctgactcagg
92941  ctgacccttc ccggccctgc aaggctctaa ggtagaacca gtgttatcac aggaaaggcc
93001  caagccaaag ctcagagcag ctgttcctga gaaagtggga gatgaggatg agtaggaggt
93061  agagatgctt ataactgctc tgcccagaga aaactcagaa ggtgcagaag agttttcaaa
93121  ataaagtgca ggccccatca agtaaaaaat gaaacattgt atttcattaa aatggtgatc
93181  agttttctct tttcataaaa gacattcaaa tggtgagatt gtaaaaaaaa aaaaaagaa
93241  aaagaaaact ttctaattct caaaaataga acagcttgaa taataactca tgggttttga
93301  aatgggtcat cttttaaaat gggtcacttt ggctagaatc attgcacttg gtgactttca
93361  cattgtaaag ggtccagttc tttctgaggc ccaattgcac tagaatctgc atttcagaac
93421  acaggaggta tcaggaagaa actgggagaa attcagaggg aaattgtctc ttctcagagt
93481  aacaaaatgt cccctattca gggggaattt tatatatgct gaagtaaata gatctcagct
93541  ttgaattttt ataatacatt atgccttttc tgaaatattt ccatagccat tattttaatg
93601  cattgttaga ataaccttgt aaggagagga attcattgta tctgtgttcc agaaactgag
93661  gcacagtaaa ttacaagagc tctgcccttt gatatcgaat ctctgtgagc gaagatgtaa
93721  ccagaacagt gtaaatctag aattactttc cttacggtat gcaatatcta attattatgt
93781  attagtttac atatatatag gggatgtaag aatctttata tttaaaggat aagaacttg
93841  atcaggtgag atacaagatt tgaataaaaa agcgatttt tagaaacatt ttaattctac
93901  aaattcagtt gctggctttg atatgtaact tattcagatt tctcttccat agaaggcttt
93961  aacactagaa gccagttctc tacaaaagag aatgttctac caagtgtgta ggcaacaaag
94021  cccaaaagtt caagttcaaa atactgttct acagcctaag atccacctaa tatttcagat
94081  ttgactcttt tgctcctttc ctataacttc ctataacttt ttcatagtgc tctaagcaaa
94141  gtaagttcaa ggatggactc acctcaagtt tccttctctt actttagagg accatataat
94201  cttatacctg tgtcatccta attgaaatgt attttaagtg cttgtgggaa caagaataac
94261  ggaagaccgt tattccatta atggaataat ggggaacatg agaaggacca tattcagtca
94321  attagggatg atacttctgc ctcaacagta tttgcgatgt gttaaatggc ccttagccat
94381  cagatcagta ttttttaaaaa ctcctaccta attaatgttt tttgagaaga agcatattat
94441  gagtatagct cagtattcta aaaagaaaaa aacctgaaaa aaaaatcagc catccattaa
94501  ctaacccatc ctggtaaagc tacacaaaca gattctagag aaaggaaatt tgcacagatg
94561  gaacatctaa tctggactga cattgtcaac aagttatctc aaatgatcct gagaaaacac
94621  tggtacatgg tttagagaca agtcgagctc atgtgactag taaatggaga ggcacagtat
94681  acatctactt ttgttggcat ttaaacactc tcggcttttt tactctcttt caccaccatc
94741  aggtccagat tccagcttgc actggaatat ttattgaccc tttgatagaa gagctacacc
94801  tgaaacatct ctgaagtctt tttagcatcc tatcctgccc atggcctact acacagtatg
94861  tgataagtta atgtttgttg aattagttaa atatacgtat taacctactt tcagggctgc
94921  ccgctgtaat gcctagaata gggcaggcac ttaataaatg gtagttaact tagactaaat
94981  gttgatccac caagacagaa acatgttaca tatacctctt gttttacacc atcttctact
95041  ttttgtacct ctgtgttata aaccctctat caagtgttgc ttctaaagac aatgtccaga
95101  atgggacgta ggaactgcca ctgggcaaca ggcagacact gggttatatc gtcatcctgt
95161  ttctgaatcc tggttttttct tattattatt caaccacagc taaacttcct gatctccttt
95221  tttccgtttt ttcccttttac cctaacttct agccaaacta agtgatttga catttcccca
95281  ctcaagccac aacttttttct cttatgtgct taaaaaaaat tcctgcgtag tctctcttgg
95341  aatgtcttat tccttgctcc ctccacttca ccctttttttt tttttttttt tttttttttt
95401  gagacggagt ctcgctctgt tgcccaggct ggagtgcaat ggtgccatct cggctcaccg
95461  caacctccgc ctcctgggtt caagcgattc tcctgcttca gcctcccgag tagctgggat
95521  tacaggcatg ctccaccaca cccagctaat ttttgtgttt ttagtagaga tggggtttca
95581  ccatgttagc caggatggtc ttgatctccc gacctcctga tccgcccgcc tcggcctccc
95641  aaagtgctgg gattacaggc atgagccacc gcaccggcc cacttcaccc tttaagccag
95701  ttgaaatgct ccttgcccta ctcctccctt ctccttttct ttctcccatc caagtactaa
95761  ccaggcccaa ccctgcttag cttctgagat cagccaggat caggtgcatt cagcggggta
95821  tggctgtaga cttctctttc tgagctgtgt cttcctcctt tcctcccaa acccacattt
95881  gaattctgtt ctagctcctg ctcatttgcc acctctccca caaagccttc ccagtttcc
95941  atcttctccc tgcttccctc atctcagagg aaagctcttc attcacagag cacctggttt
96001  ggggtccata gtttgttgtc cctcagtatc cttggggaat tagtcccagg acaccacccc
96061  cccgcccctg atatccatgc atgctcaagt cccttatata aaatggtaca gcatttatat
96121  tataacctat gcaatattcc catgtactct tttttttat tttatgtgt ttagagatgg
96181  gtctcactct gttgtccagg ctagagtgca gaggcatgta gccttgagct cctgagtcaa
96241  atgatcctcc tgcctccgcc tccaagtag ttgggattac aagtatgagc taccacacct
96301  ggcccatgta ctttaaatca tctctagatt acttataata actaatgcaa tataaatgct
96361  atgtaaacaa ttgttacacg gtattgttta gtgcataatg acaagaaaaa aatgtgcatg
96421  ttcagtacag acacgaccat aaatttttt ttcaaatgtt tttgatctgt agttggttga
96481  atctgaggat gcggaaccca tgaacgtaca cgaccaactg catatgggtt tctaataaca
```

FIGURE 3-AA

```
96541    gatttgtgga tgaagcccac ccaacataat gcaacatttc aaatgtatct tagtcagttt
96601    ttctggggca aagccagcct aacaaatctc aagaatgttt gaaaaattct agcttgagtg
96661    aacgttgttc ttctagtgac tcaaataaag cagtcattgt gtctgaggag tcctagtggg
96721    gtggcagggg tggggctagg agtagtggct gtttgtagca tgttttatat cacattaaag
96781    ggctgggtat gcatttagg caataattct tactcttatt gataggagaa cttgtatttt
96841    ttattcatct accttatgat ggataactgg tttacatctc ttcatcaggt ttacttctta
96901    cgtgtcattt tatgagctga ctttgaatat atcttcagat tttccctgcc tttacacatg
96961    aaaacggttt tgatacagct ttttcattag agaatggcag cttttccagg ccagggtgtc
97021    tgtgtctgac tcctcgcctt tcattttacc caatacttgc ttaaaacatc ctccctgagt
97081    ccggtacttt tttgcctcct ctccttcctt ccaccccacc tcttttgtc accctcctgc
97141    gactttggat ctccatcctt ggagtccctg aatctttttt gtggttgaaa gactacaccc
97201    aaaggacaca gactgatgag gtcacttctg cccactgtct agtactagtg agaccaagaa
97261    gaagaaggag ggaaaactga aatgaaggt ttgaaaaaga gtgtgttagt gaaggaagta
97321    agaacagtgc taacagaatg cagcaaaaca gaaatgactt cacacttctg gcagtgaagc
97381    aaattctcat ccatcttggg ttgcttctct tgaccctgcc cacctcctcc cctgccctcc
97441    cctcccgatg agaactgcag gaacacctgt gcccatgcca aggaaaagg gcaggtgagg
97501    aacacaggga tggggctggg actcacaagc tgctctaagc tgccacaggg tctggaattt
97561    gttgacatta catggttaac tcggtatctc gatgcctcag tatcttctgc aaaatgtgga
97621    gggagatcct ttcttcctca aaggttgttg taaggcttaa agagctacca cattcgtaag
97681    gcatttggaa cagggcctgg tatatagtag acatacccat ggtagtaact gttgctagac
97741    tgggtaaaag gagaagtttc ttaagtaggc aagaaaaaaa ctgacaacag ttatatttaa
97801    aagagcaagc aaccgtgtca gcccaaacaa gtgtgttgca agaatgagca cagagggcca
97861    agctcagaaa agcgagtgtt tgacctctct gagacctcct ttatatgtca gcttttttat
97921    ttgtttcaaa ttttgcataa tcaaactggt tactgggaat tattgagttc atataacttc
97981    cctaaaatct aagaataatc tataatccca tgccaccagt cccgttaata aagacttagg
98041    gtctgtcttt acccatttgt tcatttgaaa ttccccgtct ttacttcccc cataaccagg
98101    aaacagatct acacccatgt ttaacttata aagagatata agtgagttta cataggtgga
98161    gatcttgtac ctggattcac attgtaggtt ttattaccca gctttcccct ctatcccaaa
98221    gccatgattg ccatagtgga atttaaagtc tttggactaa cactgaatca agaactaact
98281    ctacaaatgt attctctgca ggaggataag aattccaaat ggcttctaat tgttgcccat
98341    ggcttgaaat aaagttccat atagctaaag ccccagcaca aaaacacttg aagacagcca
98401    ttaggtagaa tttcttttct tttttagagg tcttatattg gaaatgtaac agttgcaaag
98461    atatctaatg tttcaccta aaatgagt tataaaattca catttcacat tgcctccttc
98521    ctccttgagc aaacagacta ggcaattagt accaaatagt aactagttat atttcttaac
98581    accgattatt gtaagtaatt tattaagaaa aaatctagga agatcaaatt atagctttc
98641    cagtaaatct ggggcttttt attcctgatc tctctcaaca aggcagtttg gcttctgaag
98701    attggtccta gctatactta acaggaaaca gatgacgaga agaagccagg aaaaaatact
98761    tggaatatag aacaaaatgc agcataaaga tggtacagaa gattttatct ttctttcctt
98821    tagttatgtg tggacaggaa ctaaaaactc tcccacgtgg gactttatta agtaataaaa
98881    gtttaaatgt aaaagatata aaggaatgag gatataaagg aaatttttt aaaaactgtg
98941    actcaccgga ggagccttat atagtctact ttctaagcat atcactttta aagggatcat
99001    tatattttca tgatgcatgg ggatattcca agtattaaat tgattttta aatgaagaaa
99061    attatcagtt cagtcttgtt ttctatgtag gtttcactac agtattttat ttccccccgca
99121    aggaaaaaac cagagctaga atggaatgat taaatttctt agttttcttc taatctgtta
99181    gtctttccat taaattatac tgccttctta tatagaattt ctgggtttgt tcttgtttg
99241    gcaataattg aagtaagaga ggatgatttt atggtagagg tttgattcca ttctagattg
99301    gtgttttca gctatgtaga acacaatcca ttcatggttc agacaaccgt tttaggaggt
99361    tttcatgtcc agcattaaaa aaaaaaaaa aagaatagaa ttgggcattc atatatatat
99421    atatatatga atatttatta ataaaagttt aaaagatata aaggaatgag gaatgcatat
99481    atattatata tatatatacc aaattaaagt atcataatac taatacaagg attagtatcg
99541    ttttatgata ctttattata tacactaagg gttagtcttg ttttatgata ctttattata
99601    tacactaagg gttagtcttg ttttatgata ctttattata tacactaagg gttagtcttg
99661    ttttatgata ctttaggttg gtatacatac atatactaag aatgcagaca tgtccatgga
99721    agttggcaat attcagcccc cagcaggccc cagtcagcag gacagggatt aggggagtca
99781    ggtgaggcag ggctgtataa gtgcagggtt ggagcctgtc ttggtttacc gttttgacat
99841    tttgttcact gtggattttt ttcagtaact ttgatttttt aaaaatattg catcaaaata
99901    ttatactgac tacggagttt ttggtacccc cttaaattgt gcacctaaaa taagtggctc
99961    ccttgtctcc ccctagtccc ggcccgatca gtatgtttta tagagggaat ggtgagtgtt
100021   gggaactag ggagcccatg aggaggcggc ccagaagggg aggaggagct gatggtgtgt
100081   ctgatgtctc ctcctttctc taggaagcag acaggaggtg aagtcttcag ggtgggggg
100141   acagagcctg ggaggggag atttagcatg gccgctgaag agactgggaa agggagaagg
100201   ttcgggacaa gttcaggaac agtcacgtag cactgaaaac tgctcaaagc tagatagtgc
```

FIGURE 3-BB

```
100261  catttgtggt gacgctgcct gcctggtaag tcccatttcc ccagcagccc tggaggtgtc
100321  ataggaacag gaagatggga gggcgctggg gtctggggtt gttggggtgg gagggcaaag
100381  gtgtccaatg attctgcatc tgaaacgggg gaggtgtgtg aggaagaaag gtcaggagac
100441  tgctgggcag ggtggggtgg cagaaggttc tcgatgaata tttagaagtt gcagctgagg
100501  agtgagtgta ctatagagtg agtatcctgg aatttgaggt ctcagaagaa atgcagttct
100561  cagtgaagcc atgtaaacaa cttcctggct gataaggtgt cttgagtgtt gggagatcac
100621  atgatcaaaa tggtatacac accataaggt gtccttagac ttgagtgtgg tgtaagtcta
100681  ctgaataaaa tgcagaaata cagttcactg ttgcttttct tcctggaaat tgccctcccc
100741  aacctcaaac cagcccccaa gtggggcagg gtccatcttt agaccctcct gtagcaccca
100801  gcacaaccct aactatatgg tcaatgtctc tcttccccac ttagagctcc aagaccaggg
100861  ccttgtttgt cctgcttacc cactctaccc atttgttaac cccatcttaa ttttctgatg
100921  aatgagccct ttttttcattg actcctcctt tctctccttc tccggagttt attttcctc
100981  caggcccatt gctgtctctc cacctagaga gcttatccac attcatgaaa ttagtcatct
101041  tcatgctcag agtacccacc tggatctctc cagtcctgtc taactcgtct tagattatta
101101  cccctggac atctgtacct tcttgtctct ccatcgcctc gaactcaatg cgagtctaaa
101161  atcaaatact ccttcactcc taactcagga aaccagtttt ccctcccttg ttggtaatgc
101221  ttgaaattag ctcttacttc tcttcttcct cctttactcg ccatcccagg tcattcatca
101281  ggtcctgcta ggtctttgat tttcttgaaa gggccttctt tatgccttcc ttccgtcccc
101341  atttccacca ccctcgacta ggccttcctc acctcatccg gcatcagtgt gagcccttga
101401  gaaccagcg tcctgatctt caggcattct gcatttcacc ccataccacc attagccagt
101461  ttaatccctc ttgctcaaac ttaataaata ctgagcaagg gagttactat aacaaacaaa
101521  accagaaatt tctatgactt cctgctgctt tctgtacccc cctaagactc ctctacctga
101581  ttttcaaggt tctccataag caggttccca cctctctgct ttcaaatctt ctatctgcca
101641  tacacagttc ttgtctaaaa caaagattgt tcctactcct gcagccacct aaatcctagt
101701  cgtcctcagg ccctcctaaa atcctgacta atccaacccc caccgatttc tctactagtc
101761  ccagagactt ccctcttgtg cctggggttg gtgtcatgca gacacactgt accttaccag
101821  gatttgccca ttgttgtctg tgggaactat gctttcatgt gggaactacg agtcttgtca
101881  caaatagagt gtaaatgctt tgagattgga gactgtaaaa tacttcttca tgatctccca
101941  ctgtgtctgg tataagaacc cgcagagtaa atactcatat acttgtagga ttaattgaaa
102001  caactggaga ctgaggttgt ttaacttgta cttagaagtg tggacctccc catcttgatt
102061  aaaacttcaa aacggatagc aggtttcaca tattatctca gcatcacaaa agtagactca
102121  acaaagaaat gagttgacag caggggtaag gtttacaaca atcagggatt attgcaggga
102181  aacttgtagc ctttgggtgt tctaactagt ttttttcccaa aaagtttaaa gagctctctt
102241  gtgaaagaat attcttatga gtaactgagg ggcacggctc ctagactgaa aagtatttgg
102301  gatctgtcac ctctttttctg atgttcctac ttctattctt tattcttctg actacctcta
102361  ttagaaaaga taatactaag aataccctgtc ccttcttctc agtccaaata gaagcaaacc
102421  caggttgtat ctgagatatc tgcatatttt cttctaagca attctttgtc ctcttctctc
102481  ccatgctttt tctatttcct attttcagca ggctctgaag tcatttataa ttttttactgc
102541  ccctcggtga cattacatgg atattcatcc ctgatttgca gattaaagca ccgaatcaga
102601  gtgaggtgag ggttgcccaa ggttacacaa taaatctggc cccaaacagg ggtaaccctt
102661  gagtttctag tctgttgatt ggccactgac ccgtgctgca ggcacacaaa ggaagctgca
102721  cccacagcag tctgttgtgg atggttgctg agctgcgcat tcggcattgg gcttgctttg
102781  tttcctgcca ggcccagcat tttcttctac cagatcggca ggcttgtggg cttcttccta
102841  ggtccctccc ctgcactctg aataggaaag ctggaagctg tgctttagag aagctttaag
102901  acgccgaaag aaaccagaag agtgagcgcc agttgtatgt gcgtggtctc catccgcaaa
102961  gccggagctg ggcgcaacag tgttgacttg taattgatca atttagatcg ggcgcaggcc
103021  gggggagggc agtgcttttg atttaggctg ggaaaggcct cctagtgact atgttcaatt
103081  tggaggaatt cagatgttct tttgttatac aagtgaagct gtgtaataca aatgaggagt
103141  tttacttttc ctaaatcttc cccttatcat tcaagtattg aggagtttta cctttcctaa
103201  atcttcccct tatcattcca gtattatcag tgagatctgg ttgtgattta tgtaaatggt
103261  ggctaaaaaa ttcaaactac tgaggggagg aattctcatt ttacagcttc acatgctgtg
103321  ctgaactaaa taagtagcgt gggatgttgg ctttgtgaca ggtcttttgt cattttcag
103381  aaagcatttt gacttgttga tgtcaattttg gaacagctga aaaaatacag gaaaataaga
103441  taaatacgta catgttgagg gtggggacaa aatgaaggtt ctgaaccagc tgccggctta
103501  cagtagccat ataagcaaca gcagcaatgc accaacctgg tgagtaatag gcctgattca
103561  ctggagagat actagcacct ttaatgagtc agatagatgc acaatgggtg tgggagcagt
103621  tggacttgtg ggcacaaagt ctagcaagaa gctcagactt gcaaacaact gtaggacgtg
103681  caaagcaagc tggcattgga gcttgccggg cacagctgct caggaatagg cagctggttt
103741  tcccctttgat ccctgagatt ccaaaggtta cttcctcttt tgttcccttc ccagggtcaa
103801  ttagagtaga aactgcagat gcttttcagt tgagaatttt cctagaattc tcaaaaatgt
103861  gtatgctggc ttaaaatctg ccatcaagaa ttctgttacc ttgcttttaag cctccagttc
103921  cttccagatg tatggtggag gaggccagag ggcccttgtt ttggggcttc agaggatggt
```

FIGURE 3-CC

```
103981  tgttatctgg atgagcactg tggaaagact gagagagcaa ctgagagaaa gtgggcccct
104041  gaatgaaagt gatttcgcaa attttaggca gatgccacca tcagaaactg atattttctg
104101  acgtctttct caccttcctc tagagcattc agtccagaaa tgaccagcct gtccaaaggg
104161  ggaaattact gatattgatc tgttccttag agcagtgttt cagtctttt ttttttttg
104221  agatggaatc tcattctgtc acccaggctg gagtgcagtg gcacgatctc ggctcattgc
104281  aacctccacc ttcctgattc aagtgattct cctgcctcag cctcccaaga agctggaatt
104341  acaggtgtgc accaccacac ccggctaatt tttgaatttt ttatagagat ggggtttcac
104401  catgttgcca ggctggtctc aaactcctga cctcaagtga tcctcctgcc tcggcctccc
104461  aaagcgctag gattacaggc gtgagccacc atggccggcc ttcagccttt gtgatattaa
104521  agcacagcaa cacatttccc attacacccc tgaacacaca cacacagaaa acccaaagt
104581  ttcacaaaat gattcttgct cttactactc tcagtacact ctgtatttaa aaaaaaaat
104641  gctggttgtg gcttcctaag tggtgcgtgc agttttcaaa tcaatgccct tggcgataaa
104701  gtgtgcccta tactgattat ctctggacaa agtctgaatg gggcttggct ctaatctcta
104761  gtcctcattg gacattttac atacctggcc tttgcctcca ccctgatgtg gagtgatcat
104821  gggggtggga aatatagctg gatccgaaag ctctgaagtg gggatggagg tgtcacagct
104881  gaggctaggc ccattctgca gggcactcag tgtgtacagt tggttttcta tcagggtca
104941  accggcgggg ggacttgaga acagatctct gggcacaaag cagggccttt gccctgggc
105001  ttgctatgtg gctcagccta cacggctctc tcccgtcag tcctgtccaa agcccaggaa
105061  actaatgtac caccccgag gaagagagcc taccttcca tccaaggaag tgttttacct
105121  gtggtaagca cggggacag aattcttgag gaaggagggt gctgcgtccc agtggtggag
105181  gaaaagagag gacctggtgt aagcagccat ggcatggacc tcatccgagg tggcacctgg
105241  ctagggtcct gacctccaat ccttccccag taaccatcac tttgagtaaa cagtggctcc
105301  accccccggca tggttctttg caccaacatt tggggaatgc ctaccagggg tcacacactg
105361  agctggatgc tgagtgtagg gtgtccacaa catcgtgcct aaaaagtctc tgtatgggt
105421  ataagaaggt gctgggcaa tacagatgag atgagaagca tctttcaggg aatgggttga
105481  tcccaattca ggcttcccag agaaggatgt ctgtagactt catattagca agggaggaag
105541  gtagccaggc cacaggactg ctggtgtaaa gaccagggca tatgaaatgg caagtgtgac
105601  tgtgctttca gccaataatt tggtattgtc aaatgatggg accaaacagc tggagaggca
105661  gatcctaaag ggtcctgtgg gccaggctgg acttcatctt gtcactaact aatggagagg
105721  ctctgaagga gttaaaagag ctcagtttgt ctcgtggtta aatccaagtt ttacaaaggt
105781  cacgctgact gtaaagtgga aggtgggctg ccaggggat catctagtct gggtgagaag
105841  tgatgataac atgaaggggt gaagagagat ttagaagaag tgattcacag gattaaacat
105901  ttaaataatg gaagtggaga aaatgggggg ggcggttcca gatttcaggc atagatgaaa
105961  gaagtgcagt taggcacatg taaagagaaa caggaacagc aggttttagg ggagaagata
106021  acagaatggg tgagaaatga cacttgagta ccctagtgtg ctaggtaatc atctgtctac
106081  ttcccttcat ttgtcatgta tattcccatt taatttgcat aaagacttcg agttaaacgg
106141  tcttacccca atttgtcaaa tttctgcgca tgatatggta caagaaaccg taagtggcta
106201  aggcggcatt ggtgttcaaa ttgcctgact acaaaggcag tgcttgttgg ctacattctg
106261  ttgcttccca gtttagaaca tgttacattg aggcgcctgc tgcatttcca aataaaaaag
106321  tacagaaaga aggtggctgt ataaatctgg ggctcacaaa gtaattttga ttactgagag
106381  tttgctttca aggagcaaac tgtgactcct tgattatgaa ccttaattta aaaaaaaga
106441  aaaagaagt cttactctta ttcctgcctt gtctgggca agcctaatg gatttttact
106501  gctgtgaatt ttcttttcat tgaagatttt gccttgatct atgtatctgc tttcatcctg
106561  accatattca agtcagtata ttcatgaatg tacctgtttg tgaaatttga acttaagtat
106621  acacgattat agccgtttgg gaagcttttt tttttttttt tttaagagta ggagtagaaa
106681  aaggtctctg tactctgaat gggaagacag tgtaaagcaa ttttttccct tttcctgtcc
106741  tcctttaaaa aaaataaaca gccgtatgcc tctgctaagt actaactacc tcatcacctt
106801  ttgtgcagac agggcaggtt acatttggtt ttaaggaatt aggaatatgt ttctttccag
106861  caccttagta acccacgcga ttgtgattct tttctcttct tgactgtgat aggtggcatg
106921  gaatattcac atgggagagc cgcatgaggc cgcccaccac gcttcctgaa ggatgcccgt
106981  gtggaagaat tttgacgtgc cagtgtcctc gttctacagg gtgttccatt cttccgcaat
107041  ctcagaaaaa tgggactaaa agaaactatt tgtaaaata agaagacttc cattttaat
107101  gaccaacatg tattaagatg gacacctact ctacgaaaca cgaagttcta tggtctcgaa
107161  gaagcccgtg cctgtttaaa actgatccta actaaaaaca gacttgagtg gatatgagaa
107221  tgttggttag tggcagaaga gtcaaaaaat ggcagttaat tattcagtta tttgctactt
107281  gttttttagc gagcctcatg ttttttttgg aaccaatcga taatcacatt gtgagccata
107341  tgaagtcata ttcttacaga tacctcataa atagctatga ctttgtgaat gatacctgt
107401  ctcttaagca cacctcagcg gggcctcgct accaatactt gattaaccac aaggaaaagt
107461  gtcaagctca agacgtcctc cttttactgt ttgtaaaaac tgctcctgaa aactatgatc
107521  gacgttccgg aattagaagg acgtgggca atgaaaatta tgttcggtct cagctgaatg
107581  ccaacatcaa aactctgttt gccttaggaa ctcctaatcc actggaggga gaagaactac
107641  aaagaaaaact ggcttgggaa gatcaaaggt acaatgatat aattcagcaa gactttgttg
```

FIGURE 3-DD

```
107701    attctttcta caatcttact ctgaaattac ttatgcagtt cagttgggca aatacctatt
107761    gtccacatgc caaatttctt atgactgctg atgatgacat atttattcac atgccaaatc
107821    tgattgagta ccttcaaagt ttagaacaaa ttggtgttca agacttttgg attggtcgtg
107881    ttcatcgtgg tgcccctccc attagagata aaagcagcaa atactacgtg tcctatgaaa
107941    tgtaccagtg gccagcttac cctgactaca cagccggagc tgcctatgta atctccggtg
108001    atgtagctgc caaagtctat gaggcatcac agacactaaa ttcaagtctt tacatagacg
108061    atgtgttcat gggcctctgt gccaataaaa tagggatagt accgcaggac catgtgtttt
108121    tttctggaga gggtaaaact ccttatcatc cctgcatcta tgaaaaatg atgacatctc
108181    atggacactt agaagatctc caggaccttt ggaagaatgc tacagatcct aaagtaaaaa
108241    ccatttccaa aggtttttt ggtcaaatat actgcagatt aatgaagata attctccttt
108301    gtaaaattag ctatgtggac ataccctt gtagggctgc gtttatctaa tagtacttga
108361    atgttgtatg ttttcactgt cactgagtca aacctggatg aaaaaaacct ttaaatgttc
108421    gtctataccc taagtaaaat gaggacgaaa gacaaatatt ttgaaagcct agtccatcag
108481    aatgtttctt tgattctaga agctgtttaa tatcacttat ctacttcatt gcctaagttc
108541    atttcaaaga atttgtattt agaaaaggtt tatattatta gtgaaaacaa aactaaaggg
108601    aagttcaagt tctcatgtaa tgccacatat atacttgagg tgtagagatg ttattaagaa
108661    gttttgatgt tagaataatt gcttttgaa aataccaaat gaacgtacag tacaacattt
108721    caaggaaatg aatatattgt tagacaggt aagcaagttt atttttgtta aagagcactt
108781    ggtggaggta gtaggggcag ggaaaggtca gcataggaga gaaagttcat gaatctggta
108841    aaacagtctc ttgttcttaa gaggagatgt agaaaaatgt gtacaatgtt attataaaca
108901    gacaaatcac gtcttaccac atccatgtag ctactggtgt tagagtcatt aaaatacctt
108961    tttttgcatc ttttttcaaa gtttaatgtg aacttttaga aagtgatta atgttgccct
109021    aatactttat atgtttttaa tggattttt tttaagtatt agaaaatgac acataacacg
109081    ggcagctggt tgctcatagg gtccttctct agggagaaac cattgttaat tcaaataagc
109141    tgattttaat gacgttttca actggttttt aaatattcaa tattggtctg tgtttaagtt
109201    tgttatttga atgtaattta catagaggaa tataataatg gagagacttc aaatggaaag
109261    acagaacatt acaagcctaa tgtctccata attttataaa atgaaatctt agtgtctaaa
109321    tccttgtact gattactaaa attaacccac tcctccccaa caaggtctta taaccacag
109381    cactttgttc caagttcaga gttttaaatt gagagcatta aacatcaaag ttataatatc
109441    taaaacaatt tattttcat caataactgt cagaggtgat cttatttc taaatatttc
109501    aaacttgaaa acagagtaaa aaagtgatag aaaagttgcc agtttggggt taaagcattt
109561    ttaaagctgc atgttccttg taatcaaaga gatgtgtctg agatctaata gagtaagtta
109621    catttatttt acaaagcagg ataaaaatgt ggctataata cacactacct cccttcacta
109681    cagaaagaac taggtggtgt ctactgctag ggagattata tgaaggccaa aataatgact
109741    tcagcaagag tgactgaact cactctaagg cctttgactg cagaggcacc tgttagggaa
109801    aatcagatgt ctcatataat aaggtgatgt cggaaacacg caaaacaaaa cgaaaaaaga
109861    tttctcagta tacacaactg aatgatgata cttacaattt ttagcaggta gcttttaat
109921    gtttacagaa attttaattt ttttctattt tgaaatttga ggcttgttta cattgcttag
109981    ataatttaga attttaact aatgtcaaaa ctacagtgtc aaacattcta ggttgtagtt
110041    actttcagag tagatacagg gttttagatc attacagttt aagttttctg accaattaaa
110101    aaaacataga gaacaaaagc atatttgacc aagcaacaag cttataatta attttatta
110161    gttgattgat taatgatgta ttgcctttg cccatatata ccctgtgtat ctatacttgg
110221    aagtgtttaa ggttgccatt ggttgaaaac ataagtgtct ctggccatca aagtgatctt
110281    gtttacagca gtgcttttgt gaaacaatta tttatttgct gaaagagctc ttctgaactg
110341    tgtccttta attttgctt agaatagaat ggaacaagtt taaatttcaa ggaaatatga
110401    aggcacttcc tttttttcta agaaggaagt tgctagatga ttccttcatc acacttactt
110461    aaagtactga gaagagtatc tgtaaataaa agggttccaa ccttttaaaa aagaaggaaa
110521    aaacttttg gtgctccagt gtagggctat ctttttaaaa aatgtcaaca aagggaaaat
110581    aaactatcag cttggatggt cacttgaata gaagatggtt atacacagtg ttattgttaa
110641    aattttttta ccttttggtt ggtttgcatc ttttttccat attgttaatt ttataccaaa
110701    atgttaaata tttgtattac ttgaattttg ctcttgtatg gcaaataat tagtgagttt
110761    aaaaaaatc tatagtttcc aataacaac tgaaaaatta tcatgagatg tgtatttaaa
110821    ctttttcatg aacattgctt atataatcat tccttctgtc ttaatgtact acatggtctt
110881    agccctgttc ctataggatt atcatgttct ctgcattata gagccaccta agatgtactt
110941    tttgttaaat gactcatgct ggaatatctg gatggggaga tgttcttccc taatgtagtc
111001    atgtgccaca aaatgacgtt tcggttaacg atggatcaca tatatgatga tagtcccatg
111061    aaattgtaat ggaactgccc tatacaggtg taccatttt tatctttat ttcagatttt
111121    tactgtacct tttgtatatt tagatgtgtt tagatacaca aatactttcc attgtcttac
111181    aattgcctgc agtattcagt acagcaacat gctgtacagg tttctagccc aggagcaata
111241    ggctctacca tatataggg tgtctagtag gctattccat ctaggttctc gtatgtataa
111301    cctgggatgt ttgcacatcg atgtggtcac ctaaagatgc atttattggc caggcgccat
111361    ggctcacgcc tgtaatccca gcactttggg aggccgaggc aagtggacca cctgaggtta
```

FIGURE 3-EE

```
111421  ggagtttgag accagcctgg ccaacatggt gaaacsccat ctctactaaa aatacaaaaa
111481  tcagccaggt gtggtggcac acaccagtaa tcccaactac tcgggaggct gaggcaggag
111541  aattgcttga acctgggaaa gggaggttgc aatgacctga gattgtgcca ctgctctcca
111601  acctggacga cagagcgaga ctgtctcaaa aaaaaaaaaa atgcatttct cagaacttat
111661  cctcattgtt aagcaatgca tgactataat ctgttgagag agggatgaaa tcacctgtag
111721  ttatagcgct ttaagatacc atttgaaaag gttacgtttt cctttctctt gacacggtta
111781  gctgtctgaa atacagtcaa ttttaacccct aatctcttaa tatcaggaat gcccttacac
111841  ctactttgga gtgtctggtg cttcgatata gttgcatgta atgtgctctc atctgttttt
111901  acctgattcc tgctcagttc ttcacatggc atattgtgta actcaatcta tatttaaaac
111961  ttgtaagcat ccgaattatt tgtttatggt agaacttttt acttgcaagt cgtggtagga
112021  gtgtttgtag ttggtactaa aatgtgatga cttggaagaa ttaattaatg acctatattt
112081  ggggacttta attggatgct atagctgcaa tgagaataga accagagaac tcttgatatg
112141  caaggttatt cattctgtga taataatgag aggaatattc gatgtctctt tgagtcagtt
112201  ttccttccga tcacttccgc attctgcagt gacacaatcc ttaatcatag cttttcattac
112261  aatattcctt tactccagac ctcaaagact cctcactgcc tccagcatca aatctaaact
112321  cttctacctg gttttcaacg ccctacgtaa acttttcctc cttcattccc tatagcttgg
112381  tttttttttt tttatcactg ccactattat ctatcacaaa tgtcaatcat gaccatacct
112441  tgcttaagtt ggtttcccctt gccaagagca ctgttttttcc tatacctgtt gaaattttgg
112501  aaatccaatt ctacctcctc tcttcccctta agcatctctt cctttccttc tcccccaaatt
112561  tatatttagt cacatatatt atcgtactac ctactaatca ttccatgtgt ttttttacga
112621  gctgtaagtt ctgaaggcaa ccatgccttg tacagtgtcc acttagggtt ctgaataatt
112681  aatcatctcc ccaaaatctg aaagccttct atataccaag caaatttgtt tagttatgca
112741  gcaaaactca aatctataaa atcaaaaagg aataaggaaa tacagattaa acagttgcag
112801  caaagactgg tgatcttaag gtatttagtc aaagctggtg gtagaacaaa aacagtagtc
112861  ttacagattc tacctcttga ttaactcagt ggctaatttt gccttttctc aaagttcttt
112921  tgcaagaaca taaagatatt tttgtttctt tagttgagtg ctgtaacttt attcctttgt
112981  gtttctcata agtatgattt ggcagtctgc catacgtttt ttgtttttttt tcttcctctt
113041  tgagacaggg ttttgctctg tcacccaggc tgcagtgcag ctgtgtgatc acagcttagc
113101  tcactgcaga cttagcttcc tgggctcaag caatcttctc acctcagtct cctgagtaac
113161  tgagactaca ggtgcacccc accacatccg gctaaatgtt ttaatttctt gtggagatgg
113221  tgtcttcact atgttgctca ggctggtcctt caactcctgg gctcgagcaa tcctcctacc
113281  tcagcctccc aaagtgttgg aaagtgttgg gattacagac ctgagccacc acacctggcc
113341  tgttataagt taatacaata attcatcaac taacttaaag aacactaaga ctcttacaaa
113401  agtaggtatg agttttagta aaagtctcaa aagataaact gtcacttaag gaaaactaga
113461  gaacatatca ttgccaaatg gtgttttttca gagattatac cattcaacgc ccacatgctg
113521  aattgggcca ttcattataa ctccaggaac atggcaatca gtaagagccc acatgtttct
113581  ttgaatacac cgtaagtgaa agaatataaa gtagtctagt taatattatg tttaatcaag
113641  gagcacattc ctaaagatgt ttgttcattc attctacaga cattttttcag aggcctgcta
113701  agagtcaagc attatgatag acgccatgga taaaagctta caagtcaacc agcgtgggta
113761  taaataatgt gactagcact agaacaggta tcatgatggg gattctgagt ataaatattt
113821  ttttaaaata aatttccccg tgttatttt ggcttttacc tccctaattt aggctttcta
113881  aatggcacag catttctgag gatgcaaaca ccttttctaca gagcaaaaac agcatttgta
113941  taaatttgtg tctttgggga accaagagac tttaaatgtg tttaaaccaa taattcagtc
114001  aatatcaaca ttagcttaca tgtaatattc tcttgatagc ccaatttttt aaaacactgt
114061  attcttagaa gtttggttct taagatgtca ctttaagctc ttttgcttgt tgcttttgtg
114121  ggatccacaa attttgttct caggtacata aatgaaggtt agtatagagg ataaatatta
114181  tgattcttat ctgggaaaga caggtgctga ggtgtaaaag agaggatcct cgccacccat
114241  gccccgcacc ccctcgcccc ctgcacccac ggatgtgcag tcttacctgc gggggaaag
114301  gtctccgagc ctggcctgct gctccagctc agggttcccc ctttcatgat ggctttcaaa
114361  gatttcttca ctctgaagtg aaagaaattt tggtaagatt tgatattgta gggacctcct
114421  aatctatatt tttctctctc ccaatttctg tgttttgatt tggttttgag tctctcgata
114481  agcaaaatat ccagtttctc atgccgcttt ctcaggttttt ccccagccac tctgatcca
114541  ttatggttg cccttttttgg cttcctttag gcacactaaa aactccttcc caaaagcagg
114601  tatcggccgg gcgtggtggc aggcgcctgt aatcccagct actctggagg ctgaggcagg
114661  agaattgctc gaacctggga ggcggaggtt gcagtgagcc aagatcacac cattgcactc
114721  cagcctcagc aacagagcga gatgccatat ccaaaaaaaa aaaaaaagc aggtgtcctt
114781  tccccttaat catgaagggc tattcatact ttactgcccc acccctattg attcataaga
114841  ggacagtaaa gcgatcactg cattcaacat ctccttttt tttttcttgt aagaaatcaa
114901  ggtctggaaa agttgcactc gccctgagac cagaaagtgc tggaggcaga gatgaagtaa
114961  gcccagtgta ggctttcaca gatgcgtgat aacaagtcta actaaagaag tacctgggat
115021  actagttttg ccaattcagc tctaaaacaa tatggcaatc ttatattcca aatatatata
115081  tatatatttg tatttatagt agagatgggg tttcaccatg ttggctaggc tggtcttgaa
```

FIGURE 3-FF

```
115141    ctcctgacct caaatgatcc actgacctca gcctcctaaa gtggaggaaa catatatata
115201    tgttttcctt ttaaaatagg atgtcagtcc aataagaatc taaattttag ttccctctaa
115261    tatatatatc tgactaggga ccagataata ttttcatgt gtcaatatat aaaagttggc
115321    caggtgcagt ggctcatgcc tgtaatccca gcactttagg aggctgaggt cagtggatca
115381    tttgaggtca ggagttcaag accagcctag ccaacatggt gaaaccccat ctctactaaa
115441    aatacaaaaa ttagccgggc atggtggcag gcacctgtaa tccagctatt tgggaggctg
115501    aggcaggaga atcacttgag cctgggaggc agaggttgcg gtgagctgag attgcaccac
115561    tgcactccag tctgggcgac acagtgagac cctgtctcaa aagaaaaaat atatatatat
115621    atatattttt tattatattg tttattaaac aaataaaaat aaagatatc tcatcagtta
115681    cgatgtaaat gaaaaaattg tgtgtgtgtg tgtgtgtgtg tgttatgatg tacttcttgt
115741    gagttgtggt caggctttga aagccactat gtatgtgtgt gtgtgtgtac ataaaagtaa
115801    gtatcagtcc caggattcaa attcgaacca gtcccagtca aattcaatct aattattttc
115861    accacactac caaaagtctt tcttcacatt ttctatataa agttgaacta attaatacag
115921    cagtgaatgt tacattgtat cctttgcag tttctcatct atgacattac tatgcctgaa
115981    ttccccactg gactttgaac tcagtcttac tcatctttgg atcccagcg tgtaatacag
116041    gcccttcata aagagtgacc attattacta acaaaatttc ctctcactgt gaaacctgct
116101    cccaattata aaatgaattg tgctctttcg aactccgttg atctattgta tgcagggtgg
116161    atcatagagt cttatttcat aataacctag tgatggaaaa ataacaatga ttcaggagta
116221    ggtaatgagac cttgtcatct tttacactga atgatgagat ttccctaatt tatagattt
116281    gtcatgcatg agatgccctc aggagcttgc agaaatgcct tggcacgttg ctctgctgac
116341    atgtgtcaga tggctggtgt ggaggtagag ggagtctcct ctgccaagca agtctaatgg
116401    aatataacac tggtgccatt gaggatgcaa tgagaaggac ccacagcaga tccagagact
116461    gcattcataa aagctgcaca gtataccatg ttttattaag gtatagacag attagttgtg
116521    ttctagcata gtggttttca aagcctgacc acaactcaca agaagtacat aacacacaca
116581    cacacacaca tacacacaca cattttttca tttacatcgt aactgatgag atatctttta
116641    tttttatttg cttaattttt tatttctttt tttttgaga cgaaggtga attgtagcca
116701    aagtacttt aggaaatttt aaaattacac attttgaaag ctctaggagg aagagagcat
116761    attcaagtaa aacctttctt ttattcaaat agtagactaa aaaattgacc atagactaac
116821    tcagcaattg ctgccatatt tcttagtgag ggattcctta tgagctccat tgaatgataa
116881    aaggatactc ttccaaatca gagcaacaat cgtttcttgt gacactgcat cctttttccc
116941    ttccttcacc ctgaattgcc cctagggtat acctaggaga gggagggctg gcaaccagct
117001    gctgttgtga aagggatgtc attcatggcc tgccctattg ggaggccaat caggcggaac
117061    agcccctctc cccttatggt cattttatcc tgaagaaaaa gggtggcaaa aagatggcaa
117121    aaaagattgc tgatcacaga tcactgttac aaatacaaca attggctggg catggtggct
117181    cacgcctgta atcccagcac ttcgggaggc cgaggcgagt ggatcacgag gtcaagagtt
117241    caagaccagc ctgaccaaca tggtgaaaac ccgtctctac taaaaataca aaaattagcc
117301    gggcatagtg gcgcatgtct gtagtcccag ctactcagga ggctgaggca ggaaagtcac
117361    ttgaacccgg aggtggaggt tgagtgaacc aagattgtgc cactgccctc agcctgggc
117421    gacagagcaa gattccgtct ccaaaaaaaa aaaggaggg ggtggcaatg agacagggaa
117481    ctgctctggg tccaactccc ctcacatagc cccaaccccc atatccaccc cacaaacctc
117541    cacctcccca cttccagcct ctccagtttc aaagtgacgc ttaccaacac gcaggctctc
117601    caggagcacc ttgaaaggta acttcttaca tctttccaaa acacttataa tctaattgtt
117661    ctttctcccc tatattttga agaaatgcat gctctcaaaa ttgaaaaaaa cgcctagagg
117721    aattttgtaa aaaaattata ttttccagt ttctccaaag gacatataaa cccttttttaa
117781    acttagattt tgaaaagtcc caatagctga ttttcaatcg attattgaaa ttgttttttt
117841    tttcttccct aaaggggaga taccaacctt tgaacaaaat taaattaact tttccccaaa
117901    gttaaatgat tttactttgt gatttaggga atgtgtagaa agtgatttca gttccaactc
117961    ttttaaagca agggtatctg ggccaggcgt ggtggctccc tcctgtaatc ctagcgcttt
118021    gggaggccaa ggtgggggcag atcacctgtg gtcaggagtt cgagatcagc ctggccaaca
118081    tagagaaacc ccatctctac taaaaacaca aaattagctg ggtatagtgg tgcgcgcctg
118141    tactcccagc tactcgggag gctgaggcag gagaatcgct tgaacccggg agacggaggt
118201    tgcaatgagc tgagatcacg ccactgcact ccagcctggg caacagagtg agtctctgtc
118261    aaaaaaaaaa aaaaaacaa acaagcaaac aaacaaacaa aacaagggt atctggtaat
118321    ttaaggtgaa agtattattc actattataa tcaattttct taaaacagg agctattagg
118381    cccaattctg aggagagaaa aaaagcaga tttcaagggc ccgtgccacc ttctttgttt
118441    aaagcataga gaatgataat aaaatgttaa aggttcagca ttttctggca ttgtaaattt
118501    aattaattaa ttatgtaaat taattatgga aatgagaaat aaagtgaaaa ggtatgtcaa
118561    gtaagaatca ataattatca aaacgttctc taccaaatgg gatgcagggg agaagggtga
118621    gaagaaggga aggaaataaa ggcaaaggca tttgcccaca gcctcagtcc agggtgttct
118681    acatgagca gcccaagt aaaaaatact agccacagga atgagtggct ctgtcttcct
118741    ctccagaact gacgggcaaa agagggggaa cctcacccttt tttttttttt ttttttttgga
118801    aactcactgg gttttgatat ggagaacagg aagagaatct accctagcag cacattcaca
```

FIGURE 3-GG

```
118861   gatggtttgt ctgccctatt tgctccatct ccctggctct tcctagcact tctttttccta
118921   ctttccattt tcattggccg caaaagccac ttaaatattc ctttggaaaa ctgggcagtc
118981   tgtccccttt ttaaaaccac aactatttcc aggagagtta aagggctttc ggactgccca
119041   tcattcatgc attgtggtga actagctcag actgcctcta cctttagtcc agatcagctg
119101   ccttgggagg gcgattcctg gaggaaagga tgaggagagg aaggttttag gacatcgtat
119161   ggactgaagc cccgttggag gggaagggca ggcttgagga acaagcctca gtgttcctga
119221   ggctttgtgg aaatgagaaa tgaatagaga aagataagag actggatcct aaatgcaatt
119281   ttgcctattt caaaattttc acagggtctt tttttttttt ttttttgag acaaggtctt
119341   gctctgtcac ccaggctgaa gggcagtggt gtgatcatag cttcctgaag cttgcagcct
119401   cgaactcctg agctcaagcg atcatcctgc ttcagcctcc caaagcgctg ggattacagg
119461   catgagccac cacccccagc ctcagggtct ttttaatccc taagatctta aatttcccag
119521   ctactattgt tagtaatgag ttcaatttac ttactggtta aattggcttt tattattatt
119581   attatttatt ttattttatt ttattttatt tgagacagag tcttgtgctg tcgcccaggc
119641   tgtggtacag tggtgcaatc tcagctcact gcaagctctg cctccctggt tcatgccatt
119701   ctcctgcctc agcctcccga gtagctggga ctacaggcac ccgccaccac gcccagctaa
119761   ttttttgtat tttagtaga cggggtttt caccatgtta gccaggatgg tctcgatctc
119821   ctgacctcat cgtctggact aatactctaa acgctattgg caatagtttg tttacaggaa
119881   aaacatcttc ttataaagct gactgcaaat gttttaataa atttgcaaat atgtaattct
119941   gtttaaaata tcaggaagtg agaaacatgt tatgtgataa ctctttccca ttcccgaacc
120001   aagaaaatgt aaaggcagta agtgtgccaa ggacactgaa aggaagctgc ccgtacatct
120061   ttgaatcttc tcaggctgtt tggtttcatc tgattttaag ctccatggat aaatttcatt
120121   gtaacaattt ttatgtctgt aaatcttaac ccataaataa aatcacaaat cagaaaagta
120181   ctttattagg ccagtctttg tccaagcaaa tttggtccca aagctagttt acaaataatt
120241   gccacacagc tacaaggcca gtgggttgac tatcgtagca tcaatggtgt gggcagggct
120301   gcagcctctg gggcagcatt agcccccaact gacagagggt ataggtgctc ttaacaatct
120361   atgagacccc ccacaacctg gactcagctg tcataagcct ttacttctta tgttcttcct
120421   aagtacttta tcgggccaac aaattcatcc catgaggaat ccaagatgga aacgtcaaaa
120481   ctatctttgg tatcatgctt cctcccccta ccttctctgc cttgatcccc tccttcattc
120541   tacacatttt ctctgatagt cgtgttctag ccactaggga gaacgtttca gtcaatgggt
120601   atgatttctg ctcaccatct tttgccatag ctattagtaa gctctcacca ctgatgtctc
120661   agctgactgt gacaactgcc agcggctgct cagcctgcct gccttcatct aacctgctct
120721   ttactgtcta ccagagtcag cttcgtaata cacaggtgcc ctcctcctcc tgtcaacatt
120781   cctcaaccaa agcctcagta aactgtctct catctacctt cccagcattc ttgagccatt
120841   cccaggatag cctaggccct ttagacctct gagatgttat acccttcctc attctggaat
120901   gcccttcagt gtcttaccca ccttttcagag ttctatttat tcttttttt ttttagatg
120961   gagtctcact ctgtcaccca ggctggagag cagtggcacc atcttggctc actgcaccct
121021   ctgcctccca ggttcaagtg attctcctgc ctcagcctcc tgagtagctg ggattacagg
121081   tgcccgccac catgcccagc taattttgt atttttagta gagacgaggt ttcaccatgt
121141   tggtcagtct ggtcttgaac tcctgaactc aggtgatcca cccacctcag cctcccaaag
121201   tgctgggatt acaggtgtga gccaccacga ccagccttat ttattcttta gagttgaatt
121261   caaatgccac ctcctttgaa agccatcctt gatgtccttg tgaggaatta ctttctctac
121321   cacattatat attccttta ctgtagaaac gtcattctgc tttatattat aaattattag
121381   aaatatgttg tttcccccat gaaagtttca agtttcctga gtttaggcct gatgatacaa
121441   tcattttcat atgactcaca gcaattgcct tagtatatat taaattgagc tgaataagcc
121501   atgtacccag ttgaacacac caaatatttt agtgatgtca tttctttatt ggtgaaagag
121561   caaggccaac gttgatctta atgttattct ctcttttatc ttattcagct ccctcaacaa
121621   aaatacattc tcatagatta atgtaatcac cacctcactc ctctcaactt tagaccctat
121681   actagcctga gaaatccaga tccaacttaa tgagttctcc tttatcccaa gtcctcatga
121741   cctataaatg taacctctag gacaatgtta caaagagtga gatctttata ccacctgcat
121801   tcttgtcacc aaacgtgtaa gttaaaaatt cagattctga gtgtggtgac tcacgcctgt
121861   aatcccagca ctttgggagg ctgagccagg tgggtcacct gaggtcagga gttcgagacc
121921   agcctggcca acatggtgaa accctgtctc tactagaaat acaaaaatta gccaggcatg
121981   gtgacaggca cctgtaatcc cagctactct agaggctaag gcaggagaat cacttgaacc
122041   tgggaggcgg aagttgcagt gagctgagat cactccatgg cactccagct gggcaacaa
122101   agtgagactc tgtctccaaa aaaaaaaaa aatttagatt ccaggacccg accctacacc
122161   tccctaatta gaatctcaga gagtggggcc ctgggaatct gcataattca taaccttctc
122221   agagctctgg tacacaagaa accatgagaa tcttttgttct ggaaacttca gagaacttgg
122281   ctgagggcca cccaccaggatt tggtcgctc cctgaatctc ccattagctc tgacactgac
122341   tagacttcaa atatcacaga aggcaagcat tgaagtgtgt ttatattcaa atagttttct
122401   tgttgagaat cagaaatatt aataaaactt tgggagtca aagtaatgag aagacaagga
122461   actgaacttg cccctgatc tgttatcatt tggcagtaag gtacatattc aacaatagga
122521   taattctgta taagacctga atctgacctt ctttcatctt tcacactgac aattctgtct
```

FIGURE 3-HH

```
122581  ctaaacacag gattaaatga ggaactaaaa ttcaccaaga tcctgctagg tgtcaggtac
122641  agtgctagct gcttccacac atttctcatt taatcagcca cctgtgaaat tgctatgatt
122701  tatcaccatt tggcagaaaa ggacatttag ggcacaagag attaaataag ctgctggttg
122761  ggtacattaa gtattaataa ataatcagat agataagtta ggtagttaag taagctgcca
122821  gattagtaaa cagctagttt caaatcccag ctccaacatt tactagttgt atgacccttg
122881  gggaaactca acctctgagt ctcatggcac tgctgataaa acggaaaaca tcatcctcac
122941  aaggttctga ggactaggga tggactcagg tacacacagc acccagtaca atgtctggcc
123001  ttcagccagt gatagcaacc cttcactcac ctctccattc ccttccagcc cctgcattca
123061  aaaacttta tttatttatt ttttaattt aggaggctct ttgctcagaa tcctgaaaag
123121  gcttttgtta ctttattttt tcttttttt catcttctgg gagcacagaa taggcttctg
123181  ctcctttaaa taactttaac aggcaccaaa ggaacactgc tagctctttc ttaattctgt
123241  aggtccacat ttaggaaaaa gaaattgtca gcctctgact tatttccagc ttacaaaaag
123301  gctgtgatgt tggcagcccg gggaaagcag ttcccgtgag tcatgctttc acctttcagc
123361  cagtgaagaa caggaaatag tcacatcact attgccaaca agcacagcga atcgcttcca
123421  ccaccgggct ttcccagatg acgtcagtga gccaagtgca gggcatcacc cttgccagat
123481  ggccccggaa gagtctcagc tgccctgtca agtttagctt ctcaagctcc ccagaaccag
123541  catggcaagg atcacccctc cagaaaggga aatgatttct ctgatcatga tcaaacctg
123601  tcataatttt agctgtaggt ggtgagtatc agtgactgta ttatagatgg ttttggttca
123661  cagctatttt ttttctcggt atatttactc tcaagggcaa aggggtggca tttatcacaa
123721  tgctatgatt cactctacta gactggctgg gtttcatttc atctttgagt tctagaccta
123781  aggccaaaag gatgtcagaa tcgccaccca gagctagatg catgctcaat gcaacctggc
123841  catctctctc ggacagtggc cactaaacac aagctgcaat gattattgtt gatgttagtc
123901  aattgatttg tcccccttt aataatccat gatccacaca gacatgaatc taaacctttt
123961  ttttgaacct atctttttct tactagtttt cttacatatt ttggaataac aatttccctg
124021  gttataatac acaatgtgtg aaacactaat tgcatttatt ggtcctaaat tcattcccaa
124081  gtctaggatt tggggattta gtgcacaaat ccactttctt cctgctcatg ttgttcatga
124141  ctttatggat tctgcttaca tttcctccca aagccttggt ctttctaagc agaaatctga
124201  ccagcctctg ttcctactct gcttcctcca ccaccttgac tgttaacata cactgttgtg
124261  ggagaagctt ttcattaaat acgcaaacaa atcaacaata aggaagaaaa caactgaagc
124321  acagaaggat gattgtaaca tggacttgtg cttgtttaac agtacccata ctgtttggtg
124381  agttgcctaa atacagaggg agatggcaac ttaacaggat gggtttggag tctgaattaa
124441  ataaacaaca tggcaaaaga aggaagaaac caaagttgg gtgactaggg cttcttggat
124501  tctactcaac actttccaca cctacaggcc tctgattcta tccccaccgc tgctcctaca
124561  ctgtctatgt ttctcttta caacaacaac aaaaaatag cacttgttta ctgttcacaa
124621  ttattgaaat aaatcactct aatttggatt cctttatatg agaacttcca tatgcttaaa
124681  actcccgtag catttttata gtgtacaggt cataaacatg ttgtctgaag atgggcaaag
124741  taggtcgtag agataggaag tgagttcaca tcacggcgtg agtcaaggca gcagcatatg
124801  agctcagggg ccaaatctga gctgtgatca tgtgacacag tcctcacctt cagagatgac
124861  attctcccag aagtccaggg tgcagaaatg gataggctga tgttcacttt tgaagaggac
124921  cacaatgaaa cccttttaat attactcaat gattccacag acctcctggg tgttaaatca
124981  ggtgaatcta tttttaaaa ttgctattta cttttttagg tggctgatca ggacagtatg
125041  aaatttcata cagtttccta acttgagaaa acatgttgat gcaattcctc caaccaggag
125101  ggatttatgg acagcggtgg ctacgtccta atctgcccag aatacaggat gactaaacaa
125161  attggcaaac ggacgcagct ttctctctct ctaagaaaag tctgctgaga accctcgttc
125221  ccactctgtt tctgcctcca agaagaaaag cctaaaactc actttcttcc ggactctttc
125281  aaggtcagtg gagttcctct ggggttcata ttcagatact tggggattg atgatggatc
125341  ataaatgttg ctgaagttca tttgagccca tggcctctgg tttcagaacc attcagccag
125401  tcaaatattt aaatttagt gaggcagggg aaagggaacc ccttcggggg ctgctataca
125461  gcaacttata ttcacaattc acaattaaat acacttcagt ttctaaatat atgttacttt
125521  aaaattatac agtgcttagc aatttcaaa ttttcatttt gtgctcaaaa tattttcagg
125581  aggtagctgt tgttataccc atttgtacaa gcaagaaact gaggtttcaa gaggttatgt
125641  tgcttaaacc cagatctgcc tgattccaaa cctttatgctt ttttaaact tctatttga
125701  aataattata ttaagtcaca tgaggttgca aagaaatgga aagtctcatg tccccttct
125761  ccaaacctca tccaatgtta acatctaaga aattgacact ggcacaatcc acagagccta
125821  ttcagggttc accagttatt cacgcacttg tgtgtgtgca tgtgtgtgtg cagctctgtg
125881  caattttgtc atgctctttt tttttttt ttttgagaca tagtttcgct ctgttgccca
125941  ggctggagta cagtggcaca gtctctgctc actgtaacct ccaacttcca gtttcaagca
126001  attttcctgc ctcagcctcc tgagtagctg ggattacagg catctgccac cacgcccatc
126061  taattttgt attttagta gagacaaggt ttcaccatgc tagccagact ggtctcaaac
126121  tcctgacctc gtgatcttcc cacctcggcc tcccaaagtg ctgggattac aggcgtgaac
126181  caccgcgccc ggcctgtcat gctcttttta tacatgaacc atacactgtt ctgccaattt
126241  taaatatgaa ggcagattac agaaataat aaatgatttt ttctttact acaacagtat
```

FIGURE 3-II

```
126301  ctaccaataa tcacatacat gaccaaatag cttcactcc tagctgccgt taagaagaaa
126361  gaaaaggatg aaaagaaaaa aaatcctata aaccccagtt cttgaaagca ttagtctgtg
126421  ctatgtgcct taggtacaga ttaaggaaac acaatttgtt gatttattga taattgtgac
126481  agcaatcttc cctcttgtca ggaagttcta taagtaaaat aaaggtaatt ttaccttgac
126541  ttcaRattta gtctcatcat cttcctttcc ccgggagttc aactctgtct ccgtataagg
126601  ttcctcagac gttctcagag gacgagctag agggactaag agaacctgcc attagtgtgg
126661  ttatttaact tataaactat aactcagtgc actttgtctg atttggacaa atagctggac
126721  cacgtcaatg tggctaacta taaaagctca cttgagctgc tgcgttgatt tcctagggct
126781  ggatgaaatt ggaggtgaag gagagacaca gaggagaaat agaatccttg actccaggga
126841  cttgacattt cagcagaaga gaaaaaagtc acacccagca ccatatgaaa cattaaacta
126901  caacaaatct gtacatatag caatgtggta aagaatagta gattttctgt cattcccatt
126961  tttaaggccc agctaaaagg tcacttttgg ctgggtttgg tggctcacac ctgtaatccc
127021  agcactttgg gaggctgagg cggcagatc acctgaggtc aggagttcga gaccagcccg
127081  gccaacatgg tgaaatcccg tctctattaa aaatacaaaa attatccggg aacagtggca
127141  agtgcctgta atcctagtta ctcgggaggc tgaggcagga gaatcacttg aacctgggag
127201  gcggaggttg cggtgagctg agattgcgcc actgcactcc agcctgggca acagagctag
127261  actccatctc aaacaaacaa acagacaaac aaacaaaaag gccactttcc tcatgaagtc
127321  ttccatatta caaactttat ggattctttt atgcactgct gctttggcat gcatcatgtg
127381  tacagcataa tgttgcactt gatgttgttc ttggattcaa agactaaatt ctaggtacta
127441  cattgtattg aatatatttt ccattataaa ggtaattaat ttttgcttat tacagaaaat
127501  ctgaaaaaca ctaaactctt aacgctgaag cacaatcact tagtatattt ccttacagtc
127561  ttcttttcaaa tgctctccct cttttacac acatacatgt acacacacaa tcatactatg
127621  attgtattgt aagaggatgg ccatgcctgc tgctcttgct cttttctctt ggccactcta
127681  tctcccttct ccccacctgg gaaatatcct ttcttcaagc tccatggcca tttggtagta
127741  aaattgggac ttgagaggag aaggcctcaa ggcttcctaa cccaccttac cagctttgcc
127801  aagcattgtg ggtgatggcc acaaggctaa tagataagag gtactttgaa ttcttatttg
127861  tcacagtcac caccccttgca tatgctggtc ccttgggaaa ctcacaggag acatgattaa
127921  tcccaggcag gatttgagca tttctttctt tcttcttttt tttttttgag acagagtctc
127981  gctctgtcgc caggctggag tgcagtggtg tgatctcagc tcactgcaac ctccgcctcc
128041  caggttcaag cgattcttct gcctcagcct cccaagtagc tgggactaca ggcgcgcacc
128101  accatacgca gctaattttt gtattttag tagcgacgga gttttaccac gttggacagg
128161  atggtcttac tctcttgacc tcatgatctg cctgcctcgg cctcccaaag tgctgggatt
128221  acaggcgtga gccactgtgc ccagccaatt ttagcatttg taggtcccaa gaccaaaatg
128281  ccattcattg aatgccacca atatatcacc ctgattctta gctatggtag acttgatgga
128341  ggttgaccat ctgatctcca gaggcccctt ccaacccttc cattctgtga gccaactgga
128401  agcagcttgg gctttctatg ggtttttcat agatgttatg ttgaaaatcg cagaaaatta
128461  cactgctacc ccaggttata catattacca ttaatgctgc tttgtaataa cagacaatcc
128521  tttgggctcc tccctctctg tgggatctct ataaagtgag tgattccagg cacaataact
128581  agatgctaga aatgcatgca ctataatttg tgacaccatg actgagaagc gcctgtcctt
128641  gacactgtaa gtagagtgaa gcagtgaaag gcggggccac agaagccaca ctgccagtgt
128701  tcaaaccttg ctcttccatg cacgagacaa acatgattac agtcacctct gtaccttacc
128761  tttttcatct gtaaagtagg gaaaaatgag aaatcctaca gtaaagggct gtgataaggc
128821  tttaatgagt tcatttgtga agaatgtaga tcatatacaa tgcataacac atttttagcta
128881  ttattgccac atggcactaa aaagtttttt cacgttcctt atgaacttca gaggtgttag
128941  aagttgtagc caaggcatcc agctaacaag agtcagagct gaaattccag ctcttaagcc
129001  cctccacaca tcttctttat actgtgaaat acaattgctt atcttggcac agactcagtt
129061  actaaggaat cagacaaaaa tgtttgaaaa tccttttagt gacttgctgg agtccacact
129121  cagtagatac ttaccaaaaa caaaagtgca ggattgttct gcaaaacgag ctagttgttt
129181  gacttaggtc aatgacaacc tgttcagact tgacaaagac ctatttattc tgggaaggag
129241  tgttatctat tatgaaatct tgtatttgaa aagctgagaa acaaccctgt aattcctgct
129301  ttatttactt gaaacaaaca tatgtacctg gaaacaacga atgaggccaa gtcatagatg
129361  tgaacatagt ttagcttgag gacagacgaa aggtcaagag aaccaagttc tgtttccaat
129421  catctaagaa ggatgtctct gtgtatgttt gggtatgtct gtggtatgtg tgtgcaagtg
129481  tgtgagagtg tatgtgtgtg gatgtgtgtg tgtgtgtttg cagataaaaa ttcaggaaag
129541  aaatacacta aatgttatca aggcttactt ctaaaaagta ggatacatgg tggaagacaa
129601  gggatcgtaa attgtactaa atggagaatt accaaaacac cccacaattt tcatataaac
129661  aaaaactgaa agaatttatt gctaacaggc caggcatggt ggctcacaac tgtaattcca
129721  gctcttaggg aggcagaggc aggaggatag cttgagccca ggagttcgaa acctgcctgg
129781  acaatatagc aagaccccgt tctccacaaa aaggaaaaaa taaagacaag aaaagaattt
129841  gttgctagta gactccccaa caataaatac taacagaagc tctttattcc gaagagaaat
129901  gacacaagat agtaattcaa atctataata aggaatgaag aaccccagaa atggtgaata
129961  agggggtatg tacacacaca cacacacaca cacacacaca cacatgcaca cacacacgta
```

FIGURE 3-JJ

```
130021   tgtatttctc ttaatttgat acatgactat ttaaagcaaa aattataata ccatagtggg
130081   ggattaacat atatagatgt gatatttatg ataagaatag cacagaggat ggatggggag
130141   catatggaag tatgacattg tagtatgtag tatgatttcc tatattttgc atagaatggt
130201   atgaaactaa ttcaatagat catgacaagt taaggatgca tatggtaatc cccagtctgg
130261   tgaaaaacag tacaaagaga tatgataaca agccaataga ggaattaaaa caaaatatta
130321   aaaaatattt actaacccaa aggaaggcag gaaaggagga aaagaggaat aaaaagcaca
130381   tgagacatgt aggataacaa aacaggaact ctaaatccaa ctatatcaat aatgatgatg
130441   gatgtaaaca taaaaatcta atcactccaa ttacaaggca gaggtcacag tgtataaaaa
130501   ggcaagaccc aactatatgc tgcctacaac aaatatactt taaatacaaa gacagaagaa
130561   tagaaaacaa aaaaaatatg ttctgcaaac actaagcatg agaaactgg aatggctgtg
130621   acaatatcgc acaagataga ctttaagagt atttctagag gtaaggaggg aaggagagac
130681   atttcataat tataaaagag ctaatatatc tgaaagacat aaaaaccatg aatatgtatg
130741   tgcttaatga cagaggtcca caatacacga cacaaacaaa tgacatgtac atcctgccca
130801   agggcagttt attccaagga tgtacagttg ttttaacatt tgaaaacaaa tcattgtaat
130861   ttaccatatt aacaaataaa gaagaaaaac catatcattc tctcaataca tggaccaaat
130921   aagcatttga aaactcaata atcattcacg ataaaaactc tcctaaaaaa tagaaataga
130981   agagaattcc ctcaatctga taaaagacat ctgtggaaaa cctatagctt acatcatact
131041   taaagatgaa acttgaactc ttttcctaat attgggaaaa cacacagatg tctgctctca
131101   ccatttctat ttgacattgt agtggaggtc ccagtcatta taatatgaca agaaaaaaag
131161   tataaagatt gaaacagaaa aaagtaaaag catccctatt cacagatgat aggattatat
131221   ttctatatag aaatctattc ctattcttaa ttatatatgg taaattccat tcattatagg
131281   gttaaaaaaa tgttaaatgc ctaaggcctt tacactcaaa acgactgcat tgttgagaga
131341   aattaaagat gacctaaaaa acataagtta taacatattc aggaattgga aaagtcaata
131401   ttggtaagat aatagttctc tccaaattag ctcatatatc cagtgtaatc cctatcataa
131461   tcccagcaga aattgaaagg tgattctaaa atttatggaa caatgaaaag gacctaaaat
131521   agccaaaaca accttgaaaa agaacaacgt tggaacatcg catgacttga tcttaaaggc
131581   tgactaataa gctatggtaa tcaggaccat gtgggattgg cataagaact tacctatttt
131641   ttaaatcttt gctcaaagaa ccaattttac tactccattg ctaataaaac atgggccttt
131701   taaggtcct  gaatggggtc tattttatgc tgttattatt atgttattat tatgatgcat
131761   ttgttgttgt tgttgttgtt gttgagacag agttttgctc ttgtcgccca ggctggaggg
131821   caatggcgca atctctgctc actgcaacct ctgcctcccg ggttcaagca attctcctgc
131881   ctcagcctcc tgagtagctg ggattacagg cgcccgccac catgcccagg ctaatttatt
131941   tatatatata tatgtatata tatgtatgtg tgtgtgtgtg tgtgtatata tatgtgtata
132001   tacatatatg tgtatgtgtg tgtgtgtgtg tatatatata tatatatatt tttttttttt
132061   tgagacggag tctcgctctg tcacccagga tggagtgcag tggcgccatc tccgctaact
132121   gcaagctctg cctcccaggt tcacgccatt ctcctgcctc agcctcccga gtagctggga
132181   ctacaggtgc ccaccaccac gcctggctaa ttttttgtat ttttagtata gatggggttt
132241   caccgtgtta gccaggatgg tctcgatctc ctgacctcgt gatctgcccg cctcaggctc
132301   ccaaagtgct gggattacag gcgtgagcca ccgcgcccag cctaattttt ctatttttag
132361   tagagatggg tttcaacatg ttggccaggc tggtctcgaa ttcctgacct cagataatcc
132421   acccgccacg gcctcccaaa gtgctgggat tacaggcgtg agctaccgca cccggccttt
132481   atgatgcatt tttattattc cttcagtaga ttgtgtgttt ctccttgcat ccaggcactt
132541   ggtgttatct aagtgtttat gtcttccatg tctgcactat gctatatctg tagtttgttt
132601   taaatagtat ctgttaaaac agcgaccatt atccattgta gacaaccagt cacagtcctc
132661   atggtgctga tgaaacacaa aagccacaaa gcttcttttc ctcaaataac ctacccgagg
132721   tggagggctg gctggttttt gatgacaccc attttggtga agactcagga tgtgggcca
132781   caggttgcac tggacgagtc tgtttggctg ccagtttcat cagactcact tgcctcttgt
132841   gaaatatttc ctggacatca tccagcctct gcaaaacttt ctgggctttg gcctacagta
132901   acaaaagcaa atcatgatga acaggtctct ctgtatacag cctgaggaca cgaagcattc
132961   cctttctccc accttcccct actcccccca tccctacctc cctcaggtga cccctctgg
133021   gcatcactat gcaagtcgct gcaggtcctg ccatgctcca gaattgggta tctaaggatt
133081   agcctctcct acttgagacc cttgaggaca atgactacat cctttcacta tggcgtctcc
133141   agtgcctgga cacccctggc acaggagttt gagaccagcc tggtcaacat ggtgaaatca
133201   catctctact aaaaatacaa aaattagccg ggtgtggtgg ctggcacctg tcatcccagc
133261   tacttgagaa gctgaggcag gagaatcgct tgaacccagg aggcagaggt tgcactgagc
133321   cgagatcatg ccactgcact ccagcctggg cgacagagcg actccatctc agaaataaac
133381   aaacaaacaa acaattagaa tacaatgtgg cttgtgtcat gttagacaga gcaaagaatt
133441   ttggcctgag tccatggatg gacttcaggg cattcccag aattacacaa acagttagac
133501   aggctggata taatctgttt gttcctccac tgcatcttct cttcctttct ttgtgcccag
133561   gaagctgatt aaaagaagct cctaaaccag aggtgcagac aaggtgatga tgtggctctc
133621   agaggaaggt gtgctaccta caaccctgct ggcttcatgg aagaatatgc ttctcaaatg
133681   caaatccaat caagttatct ccctgcttaa atccaaactc gctcatgtgg cccacaaagc
```

FIGURE 3-KK

```
133741    ctaccttgcc  tgcctctctc  taacctcacc  caaaacacac  ttccattgct  ctctaggttc
133801    cagcaccctg  acctttggt   ctgcactgtg  ccaggctccc  tccagccctg  aagcctttgc
133861    acatgctgtt  cctcctgtct  ggaaaggctc  tcccatcttg  tctattcgtt  ctccaggctc
133921    aagtgactct  tcctgagagc  cttctctgac  cccagtccag  gtcaagttcc  tctgtcacat
133981    gcctgaccct  gcatccctcc  ttgacagcac  ttatatcagc  ttgtaacaca  ttttgtgtg
134041    attattttgt  taatgtcagc  ctctcccaca  aactgtaagc  tcagtgaggg  atggaagcat
134101    gcctattttt  aatcatcatg  gtatcctcag  cactcagcac  agcacatggt  acatcaggaa
134161    tgctcataag  cattaataga  gaaatgactg  atttgagtca  gacgaagact  cagtatgcca
134221    ggacgttcag  gccgagagtc  taagaggccg  ccggagggct  tcggaaccag  tgagcccact
134281    caattcagcc  tgctcagtac  cctgtgtgta  ctttatcagg  aagaaggtac  agtccctccc
134341    tcccctatcc  gtttcccaac  cacaggatca  aaataacccg  gaagcattac  ctttgcatcg
134401    agggtgagca  gcaactcaaa  ctcgttgtaa  aactccttgg  ggctgagcaa  cgggtactcc
134461    ttgactgtgc  ccaggaatgt  cgcaatgtcg  ttcaaggcga  tatcaacccc  ttctcgagac
134521    tggcacttgt  ctacagcttg  ggaagccaag  aggtagattc  ctgcctcaca  ccattggctg
134581    acctttttgga aagaaacagt  gccctgtgca  cttcgcctga  ccacaactca  gagccaccgt
134641    aatcctcagc  aggtctgagc  ttgtaaggtg  tctacaagga  tcccagaca   atgggaaatt
134701    gtcatggac   ggcatcgagt  ttaaggggtc  taaccactgt  aaattacact  atgaggggga
134761    caaacccaaa  ccagctgata  cctgtccact  tctcagggaa  gtcactcggt  cagcaaaatg
134821    agtctcttcc  attaacagta  attgctacat  ctccaggagg  agacagctaa  atatatattt
134881    aattaaagac  agggttttcac tctgtcaccc  aggctggagt  acagtagtgc  aattatggct
134941    taatgcagcc  tggagaggtc  taccccaggc  tcaggtgatt  cttccacctt  agcctcctga
135001    gtagctggga  ctacagatgc  atgccaccac  accaggctaa  tttttccttc  cttcctccct
135061    tccttccttc  cttccttcct  tcctcttttct ttctctctgt  ctctctttct  ttctttcctt
135121    tttttgagac  aggttttggc  catgttgccg  aggctgctct  cgaactcctg  ggctcaagca
135181    atcctcccac  ctcggcctcc  caaagtgctg  ggattacagg  tgtgaggcac  tgcacccacc
135241    cagccttata  gctaaatatc  tcttaggctg  gtctaaccat  agagaaatgt  aatcaatggc
135301    ttttggggtt  tacctgctag  tccactcttc  ttgcatccga  attggttacc  agaacacagg
135361    gtgattaata  agacattaga  cctggcccctt acatttcctg  ggagaagggc  atgtcccttt
135421    taacaaaaac  acaactttca  tctttggatt  cccaggtgat  ccctatttgc  atttactggc
135481    gtttgtcttt  cgtaaggaag  caagaatgca  aagctttgta  actcagcaca  gcgatactca
135541    agagtttctg  gatgctggga  ggacattaga  taggtgatga  gttctaatta  ttcaattttt
135601    aaaaaagact  cattttcttt  gctcttttga  actccactga  gacacttgaa  cagaaagaca
135661    gggagcccctt atgctacctg aagagttata  tgaaaagaag  tttccagtgc  caatacctct
135721    gcatttccat  ttaccatgtg  acctgaaaag  caatataaag  taactataca  gagaaaaaag
135781    atcaaaatgc  aacacgccaa  agtggttgtc  tttctaagtg  ggaaaatgat  aggcaactta
135841    agttttttgtc ttatttttttt cctagattat  ttacagtgaa  tatgtaccac  atttagaata
135901    ataaaaaatc  ataaagatat  ttcagaatta  ataattacca  ttatgtaggg  atggggata
135961    gtgggatatg  tacgtgccca  tgagtaacct  ttttcttcct  acattttgg   atttccacaa
136021    taatatgaac  tcatgctttg  atatatgctg  tgaaaacttt  ctctttacac  atcatgccca
136081    gatctgcaaa  aaacattagg  ctgggatttt  ctgtagagtt  actatggcta  cttgctttct
136141    ctctctctct  gtctccctct  ctctctctca  aacacacatg  cacacacaca  cacacacaca
136201    cacacacacc  aggcttataa  tctctggagc  aaaaatggag  ttgggaaaac  agcagctgat
136261    cccacagcga  gctcagcaca  cagagcaggc  tgcacaccag  cccctctcgga gctacttgct
136321    tctgaaacaa  ctatatttca  ttgacattaa  aatcccttta  gcaatgggat  gaggtaagcg
136381    cctgggtggg  tgcccccctgc catgcaagag  gaacagctgt  ggggatggag  catgctgact
136441    cattgccgtc  agccacatgc  tgcctgggac  cagctcacag  ggaagactcc  agaaaccgct
136501    gctcctgctg  actgggaaca  tacccctagag gtcacctcca  aagggcaccc  ctctccttgt
136561    gggcccctgg  catgcgccct  tgctgtctat  cctgtgaagc  cttggtgtgg  aatctggcag
136621    gcctgacttt  aattctggct  tccctgtgt   gcaccatgtg  tggtcttggg  cagtcattta
136681    cccagggtt   tcttggtgac  atccctgcac  cacctgcacc  agaatcattt  agacacttta
136741    ctaaaatact  agttcctggg  cagtattcca  gacctatcga  cgctgagtct  tcagggcagt
136801    gcataaggga  atctgccata  taacagctca  ctaggtgatt  tcgtcgtgac  acattttgag
136861    acccagcaga  gtatcagttt  ctgcctctgc  acaatgaggc  cattaatacc  ttcctcagag
136921    gttgtcttga  ggattataaa  tagatgacat  aatttatgttc ctggtaggaa  tgcagtaggt
136981    gctcgataca  tggtagggggg tataaaatgg  ttgttattac  ttaagcttct  ccaaaaagag
137041    tcaaaaccct  ttgcctttat  atgagggaag  cactctgcaa  atatagtgct  tggttctctg
137101    tacacctgaa  agggaatcaa  gaagtgttcc  cacagggcca  agccaaaaca  cactcttaaa
137161    gtccggctcc  acacagatag  aaatgggctt  cagttaactt  taatgggatg  tggtgggatg
137221    gccagagcac  ttttttacctt cgtgccaggt  atacttctac  accccaggat  ctgcacagtt
137281    tttaatgcct  ctcgaacatc  ttttcacata  aagcactcaa  gcctctcagc  aatcacacaa
137341    ggaagggagg  acgagtatga  tggaagcttc  ttcacagaaa  atcttgcaga  catcatgttc
137401    ttggctgtgt  tttgctcacc  ttgtccagct  gtctatgaaa  ctctaaggac  tttcctaaaa
```

FIGURE 3-LL

```
137461   tgtcccattt tttcttgttt ccattgatga aatcgtcaca gaggtgcctg agctccacac
137521   accggggcct gatggcatct gctgcataat ggtggctttg gatgagctgg tccccaacca
137581   gtgccagcag cWgggcctt tccaggggct cctgcaaagt gaacacccac agccaggcgt
137641   cagaagtcag agcatcatga ggctgagagc tgcctggtac tgtgtgctcc aagcctggag
137701   ggaggctgtg gagatgctaa cccaggatga aggctggaga acctgagaaa gctcggaatg
137761   gttccaggcc caggaagtta agcctggccc agagttgtcc acatgctgaa caacagcagt
137821   cattcattca aatacctgtt gagttctggg ctagacatcg aggatatagt gttaacaagc
137881   ccaaaatttt cagattaatg gagaattcag atatcaacta aattacacaa atcgttaaat
137941   tattacaatt gcaataaact ctagggcaga aaagcatgga gtgcacataa taagagattt
138001   tgaatacccc tattaactaa aggaacaaga gagggactg acacctgtcc ttgaggagag
138061   tggggggtga gctgaagttg aaacactggt gaaaattgga tttggacaac tcaaaggtgg
138121   tcatgacact taagaaaatat gcttgtctag gctgggcgtg tggctccca cctgtaatgc
138181   cagcactttg ggaggccgag gtgggcggat cacctgaggt caggagttca agacgcgcct
138241   gaccaacgtg gaaaaacccc gtctctacta aatacaaaaa ttagatgggc gtggtggtag
138301   gtgtctgtaa tcccaactac tcaggaggct gaggcaggag aatcgcttga acccggagag
138361   cggagattgc agtgaattga gattgcgcca ctgcactcca gcctgggtga cagagcaaga
138421   ctccatctca aaaaaaaaaa aaaaaaaaaa aagaaatatg cttgtctaaa cccttcccca
138481   aagcctgtaa gggccctgtc tacactgacc ctgtctgctc aatcacattt cctacctctt
138541   tctgcatgac acttcgctct aaccacacgt gccaagtttt cctgtttgtt taagcattcc
138601   ttcattcatc cttctcatat tattgagaac ctgctatttg ccaaacactg tcataggtgc
138661   tgggagttca ttggtaaaga aagcaggcaa aaaccccac ctcatgaaat gaagcttaca
138721   ttttaatggg agacagaggc aataaacaag tgcatgtgta ggtcatatgg tatcttagac
138781   agtgatgagt atgtggagaa aaattagatg gtggggaggg cagggagtgc tggagctagt
138841   attttaaatc ggatggtgag acagtctccc tgagaaggag tactcaagct atgcagaaaa
138901   gacttcacat agaaagcctg agactaggcc gggctgtggt ggctcacgcc tgtaatccta
138961   gcactttggg aggccgaggc aggcggattg cctgagttca ggagttggag accagcctcg
139021   gcaacacagg gaaacccat ctctactaaa acaaaaaaaa ttagccaggc atggcagcat
139081   gcgccgatag tcccagctac tctggaagct gaggcaggag aattgcttga acctgggaag
139141   aggaggttgc agtgagccaa gatcgtgcca ctgcactcca gcctgggtga gagctaggct
139201   ctgtctccaa aaaaaaaaa aaagagaaa agaaagcctg acactacagc cttagaaaga
139261   aagacccgat tttaagattg gcccttgtt ggcatctagg aacttagatt tttgggaagg
139321   tttcctccat tccctgatgt gaatggttca tgatccctga actgtttgtg caaacagtat
139381   ggtttatggt gattacttgc ttttcttct gggagtctga aatcttggta cttgccagac
139441   agaagctgct gacatgacca gccaccaata aaacctctgg gcattgagtc tctaatgagc
139501   tcccctggta gacaacattt cacacatgtt gtcacaaccc acagacgggg gcaggaagta
139561   tgtcctgtga gactcccaca ggagaggatt ctaagaagct tgtgcctggt ttcctccaga
139621   cttcacctcg catgcctttc tcctttgcta attttgctta gtactttctc atcttaatag
139681   atcataactc taatacagct acatgcagaa tcctcctagt gaatcttcga agaaatgtgt
139741   gcatggtctt gggagcgctc tgcatacaag ctgagacctg aagtcaggga caagccgtgc
139801   agtacttggc tgggaggtga aggcgtgttt gacaagtttg ggtagcagga aggaggccag
139861   tgtggctgca gcagagggag caagaaggaa atgagtggaa gactaactag aggaaagagg
139921   gggttccata gccggggtga gaggaaagcc cctgggtttg gagggaggat ctcgatcatg
139981   tttttgaaag gaccactccc ggtacagtgt ccagaataag aggaaatgca gggagactca
140041   ttaaggggct gctgcaggaa tccagccgag agatacggct tacggctggt caccaaaacta
140101   gctcctgact cgaccttct ctggattgtt cttccctggg tcatgcagag ctgagttcct
140161   gggtcacctc ctcacagcgc ttccctggcg actatatctt aagtcattct ctacaaccta
140221   ttcgcccagt cacctaggcc ctctcccaca ctttaattct ttaacagcat tatctctatc
140281   taaaaactat tttctttatt tactttaatg tagaattcct ccctcctggc tgggcgcggt
140341   ggctcacacc agtaatccca gcactttggg aggccgagac gggcagatca tgaggtcagg
140401   agatcgagac catcctggct aacacggtga accccatctc tactaaaaa gacaaaaaat
140461   tagccaggca tggtggcaca cacctgtagt cccagctact cgggaggctg aggcaggaga
140521   atagcttgaa cctgggaggc ggaggttgca gtaagctgag attgtgccac tgcactccag
140581   cctgggcaac agaatgagac tctgtctcca aaaaaaaaaa agaattcctc cctcctccac
140641   tcactcccac caaaatgtaa gttccatgag agcatttagt aggcatgcaa taaaatttg
140701   atcaacaaaa taaatgaatg agccaatgag ctacatgatg cggtgacctg cttggctgga
140761   actctgtgaa gcaatcagca cagatgactg ccacattcca aaaggtctgc aggagcagag
140821   agcccatgag ccccttgcc agccacacta agcatccagt gcatcactgc actgctttag
140881   ctgtttacag taacacaagg agtcacggta actccaggtg cgtacatctt gcccctctct
140941   taacttgcac tggtttatgg tttcaacaat ttccaaaccc cttttcctctt accctcccag
141001   tcattcacga agcccgcag ggaccgtcgc cttcttaatg cctttcaaat tctgaccccca
141061   tctctgccac ctccttgtca ctgtctgctc aggcctcatg gcttctcatg gggacaactg
141121   gtctccctgc ttttcttcag gctctccttc aaatcatgct ccagactgct gacaaaggag
```

FIGURE 3-MM

```
141181    caattccaac atatcttatt gtgtctacat cactcccaag cttcaagccc tttcctgggc
141241    gcccagggtc ttcaggagca agcttaaact cttgagcaat gcacacgggg aatttcatta
141301    tctagctcat acctgggtgt gcctgactta ccaagtcctc ttccacttcc tcaactccat
141361    tctctgctgc aaccatacta attatccact tattgttccc caaatattca ggcagcttca
141421    ggcctccatc ccttctccac ctgctgtctg cctagaaagc ccatccttcc ctactccccc
141481    tcacccatac tcctctgggg ccaactcgat ctaaatcata tttcagactt caccttctcc
141541    agaaaacttt ctctgtgctt ctcttgatca gagcacctgc ttcattatgt tgtgaccact
141601    tatctgctgc ctgcgctatg ccacagacac ctatggtcca gaaccagctc ttattcaact
141661    gaaaacagtg catgctgcat cttaggtact tacaaataaa tgctgcacaa aacaaagagg
141721    agtactggta tagaaacaag tgacacaaat caagtagtgg ctagttaaaa ggactgaggc
141781    aaaaatacccc agaacacttg ttctaaacag caaaggccca ggtgcactgg ttaccacccc
141841    tacaagatga ctggaatact cattccctgg gcagtgattt tttttttttt ttttttttg
141901    agatggaatc ttgctctgta gctaggctgg agtgcagtgg cttgatctag gctcactgaa
141961    aattctgcct ccggggttca agcgattctc ctccctcagc ctcccgagta gctgggacta
142021    taggcgccca ccactatgcc tggctaattt tttttttttt taattttag cagagatggg
142081    gtttcaccat gttgcccagg ctggtctcga actcctgagc tcaggcaatt cacccgcctc
142141    ggcctcccaa agtgctagga ttacaggcgt gagccaccgc gcctggtctg ggcagtgatt
142201    tttgactctt tggttcactg ctgtgtcctc agaacttaaa cagtacctgg catggtagga
142261    gatgaataaa tatttgcaga atagatgtcg aatgaatgac agacctttcc tagcactgct
142321    cagctaccgc agactgaacc tagcacatgt tccatagccc agaatttatc cctctacctc
142381    tgtaatgtta ataacaacag ctaacatcta ctgagagctt aacagatgcc aggcactgtt
142441    ctgaatgctt tacatttgct tatttcctta actcttcaca acaaacccctt tgatacaggt
142501    actgttttac caaagggaag tggagcacaa tggcccaagg tgacccaggt aggaaagaga
142561    agagccaggc ttcaaaccca ggcagtcttg ctccaggatc tggctcagac caacatacac
142621    agagaaaaat ggctgcactt gttctgccta aacttagaga ccctcatttgg ttgctcgaac
142681    ttgtctgact ttagtcaaat atagaaacat gagacttggc atgaaagtct ctgttgacac
142741    tttttttttt tttaagtcca gctgcctaat ttattaagaa cagggcagaa ttttctgggt
142801    ccagggaaat tcaccacagg atacttccaa atcaccctgt ggtgatcaga gcctgccctt
142861    ccctcagcat acagtatttc acccttcaga attttccaga agacatttga gatgttagag
142921    ggaagatgtg tgtaacaggt ccaaatgggt ctagggagaa acgcccataa aggcaactga
142981    ggaggccggg cgcagtgggt cacgcctgta atcccagcac tttgggaagc caaggccggc
143041    ggatcacaag gtcaggagtt agagaccagc ctgaccaaca tggtgaaacc ccatctctac
143101    taaaaataca aaaattagcc gggtgtggtg gagggtacct gtagtcccag ctactggga
143161    ggctgagaca gaagaatcgc ttgaacccag gaggcgggag ttgcagtgag ctgagattgt
143221    gccactgcac tccagcctgg gcggcaagag tgaaactccg tctcaaaaaa aagggcaact
143281    aaggagcaac ccggattcag ccaccacatg gctggaaggt cactattaca gaattgaaag
143341    gacaacaata gtttctgacc actgactact gaccaccaac catattgcaa gctgaccaca
143401    tgaagtccct accacacatc taactcattt aatcttcaca aggtctctgt gaggcaggaa
143461    ttattacctc tgctttacag atgaggggga ccatattcag aaaggctacg aaacgtgact
143521    agggtcatac agctggtact tgttagagcc aagatttgaa tccatcccta tccgacttcc
143581    aaagcctgtg ttcttgtcac cttccagccc acctggcctc tacacatgtg ctatgaaatc
143641    ctcctggtgc ctgcaaagaa atttatggtg aaacctccaa attgaagctt atttttttag
143701    tttatatacc tcccactcag gataaatagt catcaaaatc tccaaagtaa aaaagaaaga
143761    gtgagggaaa aaatggctaa aatcttctga tcacaagccc atctgggatc tttcagatgc
143821    tgaaaattcc agaaggctgg atcgtcaagt ttcagcttag aagttgcaat cagaaatctt
143881    tattgaaata agtttatttc cccccgagga ctctgctggt ataacagatg agagatgaga
143941    gtgcctacta gggaagaaag tggcgagaaa gcgagtgatg ctactctatc cgggaatcta
144001    gaacaaaccc acagaggatc cacagggatg gagtgtgtgt atggggaggt gggccagatg
144061    aaacaagaaa ggcagaaagc taatggttgt tgaaattgaa tgatggacac ttggagttca
144121    ttgtgccagt ctatctgctt ctctgtgtgt ttgaaaattt cacacatgta cacaaagcca
144181    tgaccctcca acaagatgac atccttagat gttaatggcc tgggttccat gccttcttag
144241    acacagcacc cttatgggga gaggtcaagg ctgaaatcag gtggttcctc caccctgtcc
144301    tggtctgttc cctgctggcc cctcagcaag ggtctcagta cggcccacag tcaaaaccct
144361    gcagcaagtt ctgcttttat agaagacctt ctgtaagtgg ttgaaactac tgttttcag
144421    aatcaggaag gagcattcaa aagactgcta aaccctcaaa cgagaacaag ataaagaaca
144481    ggctgaatca gcatgcgaca ggagcctggt tagtgagttg actgaggtta cttgtgagaa
144541    tgatgtcact gtgtggaata aggaagctgg caacacccca gagccagcgt gtggctgtgc
144601    tgggagggag ctggcccctt agtgccgagt aaaggacaaa ctccaggcag atatttgtca
144661    gattgtggcc agacacagtc ttgttccttt aacactttaa aggacaaatg gaaagattag
144721    ccaagcccta atcatctgaa gaagccatgt gtctgagaag tctgagggaa gatatattga
144781    aaacgatctc agttacgatg agacagcttt gtttgattta cgcaaaggca gagacacagg
144841    tgtactacat ccttcaggaa gcaagtttag aaataagatc tgcaagtcat aggatgtgac
```

FIGURE 3-NN

```
144901  aggtctgcaa atcctgcaag tcacaggtca tccacagtgg gctagtctag ctgcttcaag
144961  aatgttgccc acgaaaggtg ggtcatgggt tcacagagca ttcctgtgtt ccataaccac
145021  aggtttcatc cctaactctg gtcagcaact tttgaagtat ataccaagga ccacaagttc
145081  aaggaagtgg gcagaagaaa gaatgtgatg cagtcatgca gatccatcgc cactattcaa
145141  gacacagccc agagcgcctt ccaagggctt tctgttccac tgagaataaa attcaaatcc
145201  tcacaaaaga tctcagggtg caacaggact acctggcctc tgctcatctc tgttcactca
145261  tttcctcctg gcccacctgc tctagcaatg ttccttgaac tcaccaagct catttccact
145321  ttaggacctt tgcacctgca gctcgctctt gctttgatac tattccctaa gtctttgcat
145381  gattacacag atcaaacaga tctcagacca aaggtcgtct tctcaggcct ttccagacca
145441  ttctagctaa agtagcatcc ccagtcactt tctattatat cttgttttct tttttatatc
145501  acttgttact atctgatgtt attatttatt tgattgcttt ttagtgaact gtctctctcc
145561  agtagaatgt aagctccatg agggcagatt ctggactgtc tggctcaccg ctgcacccac
145621  ggaacctagg ataaggaata cctcttgatg aataaataac cctctggata ggtcagtagc
145681  tactttcata tatatatgaa ggcatttttt ttgatgaggc acttttttctt aatatatgaa
145741  taagcaaaaa aatatagtat ctatattcag taaaaaatta ttttgaaaaa actaaaatga
145801  tataaggttg gggctgtcct ggagaatcta aggtatctag tcatcatata tatgaaattc
145861  aacttttcca ttgtttgata aatgttcctg atgactcatg tgtctttagc actagtttat
145921  ctgtcaaatg gtcactggta agagaaagag cgctcgctgt gaagggatgg gattcctgaa
145981  tggggatctg gatacacagc tgggtttgtg tgttcatgca tgtgcacaag cacctgcagc
146041  tcagaatcta caaccaacag ctcttagagt cagtgtggcc ttggtatact ttgttttgta
146101  tcctttaggg gtgtgtgtct ccaactttaa cgtacaagtc aatcacctgg ggatcttctt
146161  aaaatgcaga ttccaattcc agggtggggt ctgagatttt atatttctaa ttagcgctta
146221  ctcaggtgac atctgtgctg ctggccagag gctcacactt tggcaaatct ctagtactgc
146281  aaaattgccg tctgagaaac atgcctccag attagctaag aaaggaagcg ctaaccacag
146341  gggacttggt ccccaagacc caaaaatata gagaacctaa tttcaaacaa gcagaaagga
146401  acttctctgg aaagagacga ctcagctttc ttcatttgta ataaaccaaa tctgtaaaca
146461  cttaaaatgg aatcatttct aaatgctgac ttgtgtgcgg atctgggaca ctgtttaatt
146521  ccagtatggg actgtaaaat acatattctt ttacaagttt cacatttaca actcttggga
146581  catgagaaag gagaaagctt tgccaattct gtgtagcaat ggaactaaca tggaccaatt
146641  tcccccatct aattgtcttg ctccaggtat aaaactagtt gttttttttt ttctggtttc
146701  tcctttgaaa gtttcccatc cttactacca accccacaac ccccagcccc ctagtccagg
146761  ctccagggag gagctcaagc tgatgggtga gcctctgata taattgttct ggtgagtgat
146821  gagcctgttg tgaccttctc ccacttggct gctgaccacg tgagagggca gggctggtcc
146881  agagtcctca cccgacctga gcgtccaact gcaactgtat gttccggcag ctttaatagg
146941  actctgtgct gcccgtatta ttcatagcag ttgttaatgt gcctctctcc ttgggatcct
147001  ggggtgactg aagggcagga ctgggcattc ctgtgtcctt tagcaacctt ccaatagcaa
147061  tgactggaca tgatccatca ttgtccacag caacctccct cccagtacac aaaaatgtca
147121  gaaagcaaac ctggcttttt tcctccagtt ttttgtgttc cttaagaaKc tgctccacgt
147181  gcatcacgct gtctccaatg cctgtaaact ctgcttgctc ttccagcaaa ttatccaggg
147241  caagcttagc ctacaagaaa cattagaaca gtccagaagt aaaccaacac tcactcacct
```

```
1       attcccacat ttacagtaac ccctgtttcc agaaaataaa tatcaagata aggaaagtga
61      cactaaagag acacgcagcc actctgcctg taccctctct ggaccttaaa gagttaaagc
121     ctagccatga tttcctacca gggctgaggc taatgtaaac cacctgctca gacRcaagaa
181     gcaggaccag agggtcaagt tgctgagctc tgaagtctgt tctgaaaaag cttcagtttt
241     aagtacagaa caagtgatag gccaaaggcc agagggtctg agctgcagca gcactgctct
301     ccttaccccg cccttggcct gggtgccagc tcctttgaga ctgcctctta gccacttact
361     gcccatcaag ggaacaccag acctacctca agataacacc aaagtgacct ttggtcccag
421     agagttgtta aactataccg atctctcagc tcatgggccc ttgcttctgc tgaaccctca
481     ttctcttagt gctaactccc actcccagaa tttcagggcc caaagcccac acaagctccc
541     acctcaaagg gtccttccca gaacccacc ccttctcca cctgatagtt ccaaaggcct
601     acagcctcac agctcacaaa ggaaatggct gccccatctg tgcgccagtg ctcacttgca
661     aaatttacca ccacttaccc tgagacgctg cctgcctgta gcctaagaat tccatgctct
721     gtaccccttt cttagaaaga tactccccat ctgagagaca ctcacatcca aagagtgaaa
781     accctgatct tggggctcct cctcctccaa ctctRggacg gataggccag gaggcacatg
841     caagcaaaca ccgagatctc acctggcagg ttacccagag gggccaagcc accttgccct
901     aggctaataa gctataaaaa cagcatagga aatactttgc tggtacatcc cctgcctctg
961     agaagataaa aggcaagagg accagtggct ccaagagacg ccatacagag aaaaacaatc
1021    tttctcaatt cctggggagt cctgggtaga ccgtctggtc caagtccaaa gagtttcctg
1081    aggtcggggc aaaccagttt ggtccatcta aagggactag cttgggctga agcctcctct
1141    tcacacagac cactccatct ttgtagccta gagtttggca cagaacccca aagccctgga
1201    gaggaacaag ggagggatta cagaggaaac caagcttctc tggtttcttc aaaagtggct
1261    tacagatgtc tgccccttct cccgttctc tggagggtcc agatcaggat gatggcaaaa
1321    gagctgcaat caggaaccag acctgcaacc aggcctgcag ccatgtattg tactggggcg
1381    cgtacacata cacacacaca cacacacaca cacacacaca cacacacaca cacacacaca
1441    cacacacaca cacactgacc tgggccccc accactatat tcacacaccc tggtccctat
1501    cagctgacaa aatgaacctt ttttcactgc ccaccaccgt gcacacaccc acggcctcac
1561    gcagaaatgg tgaagccctc tcctgagctg tctctacagc tcaacgtgca ggcaaacacg
1621    ctttccttct ctgaacaaaa acatgctgac atctacgcaa ggggaaaga aagcaaccct
1681    ttgctctgaa aggcgccaac tcccggatgt tggcaagctc tgctccacag cgcctgtttc
1741    tgagtatgtt tacttgctct ccctcttctc tccctcccct ttaaggatgg cgcaggaaag
1801    ggaggtgagg ggggagaatc caccccaccc cctcgtccat gtttgaacaa aaacccagag
1861    aaagagtgag ggagaaaaag tctcggtgcg gggggccctt accagactcc taaagccaaa
1921    cgtatctaca ggttttaatc cgccattagc atttaaatct tgaaaggaga ggaggaaggg
1981    ggggccagtg gaaagtaacc ccacacacaa aagaaaagtt gttggttttc ttctcagtct
2041    gcctggcagg agcgatcttc ctggctgaca gccagaagtg cgtcacagcc aggagtctgc
2101    tttcttttaaa ggcacagcaa gcttccccga tctgggagcg acagcaagca ggggactctc
2161    agtggggtg gggcccagag ggaggggtg cactggagag gagggctgc aaagggggaag
2221    gctggaggct tggtccacga caagaaaag caggacgaat ggggcggcg ggttgagggt
2281    gaaggcacaa gcaggcaggc aaaattactg aactccaaca gcagcaagag ccaaggcaaa
2341    ctgtggcata aacacacaaa acacatctta cagtggcctg cctgacaaac tgggatcaac
2401    cggacactcc cccttcgctc tgttttccac ccagagttta aggcagcagt aataatctgt
2461    ccatctctct ggacagcaat ggaagggtag gacaagggct gtcctgataa ttagatcagc
2521    ccctgcctgg cggaccgcag ggcaaggagg aagacccggg aacagaggct ttgaagaaca
2581    agcaacatgc aggccctctg atcggggca ccttcctgcc ggccccaggg caggctgtgt
2641    ctttaagtac aaccatgcca ctcacacaca aagcgccctg ccaccttcca tgggcaccgc
2701    ctgccctgct ctgggacacg gccacccact aaatccattc cccgagggaa tctctccagc
2761    ccataccttc tgcgtggcaa ggccaggatg ccgtgctgtg cccgctcctc cccctccgcc
2821    acccaaacaa gaagcccagg cagattctgg ccctggagta caggcctgcg ctgtcctgtg
2881    ctgcgtgcta ttgtcggctg tggaatggcc gccaaaatcc cagctgtgct gccagaacct
2941    aatccctgt tccgctgagc atttatgggg aggggctgag gggccaaggc acgagaccga
3001    gtacgccagg cactggctgc agcccttaac agacgcaggc acggggactt gtagactctg
3061    cttctcctac atggctgaaa acaaaagatg tctgactctt agaagacaaa atcacagcat
3121    ttcccccac tgaatagcga acttcaccaa ggctgaaagg gaagcccacc agatggtcaa
3181    caggcacccc ctaatcttat gccacaaaca tttactgagc acctactatg tgtaaggcac
3241    tcctatagga aactgtagga agtatacaca gatgaattaa gcccagcatc cgcactgagg
3301    taggttgtaa ttcacaggag ataagaaata tgacttgaag attaatttca aactggtgtg
3361    ctaacttcca taaaagctgt aaagaaaaat tctaaccagt ttagaatagg gaaggattac
3421    gaaaatgaag tgccatttta atttggacct tgaaacacac aggtagcatt tccccagatR
3481    gaaacagaga ggtgtgggga ggagagaaa gcagagagga ggcatggaag cagtgggaga
```

FIGURE 4-B

```
3541  aagggcttga agagtgaggt ggggtcagag agctaggaga atcttgaacc tcaaaccaag
3601  gaatcaaaga cttgtaagtt tgtttgttat taacacagag ctgtggtatg acaaaaactg
3661  tgccccaagt ttattctgat atatacctga atgagactag cagcaatgag gtgagtcagg
3721  aagctgcaca gtcaggagac aggtaatgag ggcacacaag agggtaaggt aagaaagaat
3781  ggaaaggggc cttggcacga cggctcacac ctgtaatccc agcactttgg gtggaccact
3841  gaagtccgag agttggagac cagccggggc aacataggga gatcccatct ctacaaaaaa
3901  tttcatgaat aaaaaattag ccgggtgtgg tggcccgcac ctacagttcc agctacttgg
3961  gaggctgagg tgggaggatc acttgaaccc aggtggaagc tgcagtgaga gacattgtgg
4021  agacagggta aagaactgat aggaggcaga gagaggaact gtacagggga ggaaagtatg
4081  agggatgata tgcagaatta aactgaggag atgacaggat gtcagaacaa gagagaaaac
4141  agagtataat aaatagtagc tggtggggca cggtggctca cgcctgtaat cccagcactt
4201  tgagaggcca gcctgggcaa catggcgaaa ccctgtttct accaaaaaat acaaaaaacc
4261  acacaaaaaa acaaaaacaa aaaattagcc aggcggagtt cttttttttt ttttttttt
4321  ttttaaagca gggtctcact ctgtcaccca ggctggaggg cagtggcgag atcatagttc
4381  actgtaacct caaacttctg ggatcaagtg atccatctgc ctcagcctcc caagcagtgg
4441  gagtacaggt gtgtgccacc atgcctggct aattttttt tttttttttt tctgtagaga
4501  caggctctca ctatgttgcc taggcacagc attattttaa attcttctct aaaaattcta
4561  tgcttctccc aaagccctgg gatacaggca tgaaccacca cacctggccc acagttgtct
4621  ttgtctttt ctactaggag ctatactata gaggtcacaa tcattggcta cagtttataa
4681  tataggct aaaatgtttt acatataaga taaccagtaa aacttcatga tttagaaaca
4741  aattagtgtc ttttttagtg tcagagtccc agctactcag gaggctaggg tgggagaatt
4801  ccttgaactc ggaatgagca gagatcatgc cactgcactc cagcctgggt gccagagcaa
4861  gactctgtct caataaatac ataaataaat ggacagatag ataaacagag agacagaaag
4921  acatatagta gctaatgctt actgagtgca tactatgtac gcgacactat tctactgacc
4981  taatatgtac gaactcatta atcttaaaaa ctcccttaat gaagtaggta ccattatcac
5041  ccaactttag agaggaggat attgagccac aagattaaat aatttgccaa gatcacatag
5101  caagtaaatg gcagaagtct ctaccacatg ctgctaacta tttgacattg gcaagaaact
5161  tctgaacttt agtatcccta tttgtaaaac aagaataaag acacctgtta taaagcaatg
5221  aaaattaatt caataacacc tataaggtgt ccaacacact ggctagcatg taaggcatag
5281  gatgggtgtt tcctgcagac taattcctac ttggcatttt ggtcccttgt caccaaggtg
5341  tccaagcaga agttggctca ccaattgttt gggaagccag agagggtatt ctgcctggag
5401  caggagactg gatcctctgt ctgtctgcct tcttcccatc agtctgcctc tctagatttt
5461  actttagggt ccagctcaaa tatttaatat atttgattta atattcctaa ctcctcaaat
5521  atttaacagt taacaggggt tactttgggg gggggagga gttagattgt agggaacatt
5581  cacttgggga ctttctatgc tgtatgtttg cttttttttt tttttttttg agatggagtc
5641  ttgccctgtc acccaggctg gagtacaatg gcatgatctc agctcaatgc aacctctgtc
5701  tcctgggttc aaatgattct cctgccacag cctaccaagt agctgagatt acaggcacct
5761  gccaccatgc ccagctgatt tttttatttt tagtagagac agggtttgac catgttggcc
5821  aggcttgtct cgaactcctg acctcgtgat ccgcctgcct caggctccca agtgctggat
5881  tacaggtgtg agccactgtg cctggccttg catttatttt taataatctt gtattacact
5941  ggtgataaga aaatgtaac tacctcctac tcttggcact tatgtgtata tgcatgaaaa
6001  tcttgtcttc acatctagaa tggaaattcc tcaagggcat aaccagttcc acctctctct
6061  ctctgtgatc ccccataaca cctagcacac tagggctcct taaatctgct tctccaaact
6121  acatctggat gtcaggttta caaattcaac tttctggcca ccagagaatg actgtggtgg
6181  gtggttggga tgaggtgggg gtgggggtca gaccaaggct cattgctgta ggctccccat
6241  cacctgctgc ttcttccagg ccctgtaagc tattcccact gtatcatttg tagtctgtag
6301  ttagcaatca ctattagtag aaatggaagt tcttatccaa aggagcacca tgaaagcaaa
6361  ggcaaagcag ataccaaaac ttttacagaa aagcaaagtg gcaaacataa ttgtttgggt
6421  ttttgttgtt tttgttttct tgagacagtc tcactctgtc acccaggctt gagtgcaagt
6481  ggcacaatca tggctcactg cagcctcagc ctcctgggct caaacaatcc tcccacctca
6541  gcctccggag tagttgggac cacaggtgca tgccaccacg cctgactaat ttttgtattt
6601  ttttgtagag acagaatttc accatgttgc ccaggctggt ctcgaactcc tgggctcaag
6661  cgatctgcct gcttcagcct cccaaagtgc taggattaca ggcatgagcc atcacaggcc
6721  tggccaaact taatttaaag actggcatta tcaatgctcc agaaaatgta taaggtgaaa
6781  ataggaggga ggcctgctaa aactgccctg gccacatatg gcaatgcatc agccctgaag
6841  cttcctagcc cagatagaat tgatattgtc tcaaaagcgt acaagaggtc tccccagcct
6901  ggcccccttgc tctaaactca aggcaacagc ttccagctgt gcagcttccg agaggctgaa
6961  ccttccccta gaacccctct gcaaagctgc caagtttctg ggccagtctct tcaggacagc
7021  ccaaggagcc tggccagttt cgccaggctt tcctcctct tcctccctcc tgtggcagca
7081  gcagaatttc cacagcccct ctcacagcct agacaggcag caggcggcca catggctcct
7141  gcctgattct tactgtcctc agaagagcgg gaaaggagtg gtaaaacctt tctagaaaaa
7201  gagaagggcc gggcacggtg gctcacgcct gtaatcccag cactttggga ggccgaggca
```

FIGURE 4-C

```
 7261    ggcggatcac ctgaggtcag gagttcgaga ccagcctgac caacatggag aaacccatc
 7321    tctactaaaa atacaaaatt agctgggtgt ggtggcgcat gcctgtaatc ccagctattc
 7381    gggaggctga ggcaggagaa ttgcttgaat cctggaggcg gaggttgtgg tgagccgaga
 7441    tcgtgccatt gcactacacc ctgggtaaca agggtgaaac tccatctcaa aaaaagaaga
 7501    aaaagagaag aaagaaaggg gtggagagcg gggagaggga gagagagaga gagagaaagg
 7561    aacaaaggaa ggaaagagaa gaagaaagga aggaaagaaa ttactttaaa ttcagtaggg
 7621    agggctgggc acagtggctc atgccttaat cccagaactt tgggaggtcg aggtgggcag
 7681    attgtttgag ctcaagagtt caagaccaac ctatccaacg tgacaaaatc ccatgtctac
 7741    taaaaataca aaaattagct gagtgtggtg gcaggagcct gtaatctcag ctacttggga
 7801    ggctgaggca agagaatcac ttgaatccgg gaggcggagg ttgcagtgag ctgagattgc
 7861    gccattgcac tccagtctgg gtgacagagt gggactccat tgcaaaaaaa gagaaaaaaa
 7921    aagaattta aattaaaata aataaataaa tttcagtaga gttcagatag aggttgaagc
 7981    ggggtggtga ctggttagga gcacaaaggt tatttcaaag ggtcaggtga tcctcctgcc
 8041    tcagcctcct gagtagctgg gactacatgc acatgccatc gcatcaggat ttacattatc
 8101    atttttgaaa gtttaaacaa aaaagactg gagctgggtg tggtggctca tgcccgtaat
 8161    cccagaactt tggcaggcca aggtgggagg ataatttgag tcaggagtt caaattcctc
 8221    aggagttcaa gaccagcctg ggtaacatag cgagatcccc atctctacaa aaaataaaag
 8281    aattagccag acatggtggt gtgtgcctgt agtcctagct actcaggagg ctgaggtggg
 8341    aggattgctt gagtccagga gtttgaggtt atagtgagct atgatcatgc cactgcactc
 8401    tagcctgggc aacagagcaa gacacgtctc aaaaaaaaac aaaaacaaaa acaaataagt
 8461    actaggagag ttcaagtccc cagtcatccc catgggatga ttctcacaca aataattagc
 8521    ctggcactca aggccctcca tgacctgcag cttctagagt tctagcttct agagtcgtta
 8581    ttcccttacc caaaccctcc actctgccag gcaggtctat aaagttacag tttgtcctga
 8641    gaattagaca agatgaccgc aggggacagg ctctggatta gctacgaatt acaacagtaa
 8701    cagcaacgat aatgatagtc tttactatgc caggatgtaa gtgacagaga aaagactaga
 8761    aggcattgta ttgggcagtt ttgtttattt tactttattt ttttaataaa attaaaaaat
 8821    atatggaact cttcacaaat ttgcatgtca tcctcgcaca ggggccatgc taatctctgt
 8881    atcgttccta ttttatttg ttccaatttt agtatacatg ctgccgaacc aagcactggg
 8941    cagttttaaa aatgaagaaa tctgaggctc aggaattagg tgacctacgt gatctagtca
 9001    tgtaagtagt aagttgtcta ccttgtccct atattattct ttttgtttt tttctttcaa
 9061    gatggagtct cgctctgtcg cccaggttgg ggtgcagtgc tgcgatctcc gctcaccgca
 9121    acctctgcct cccgggttca tgtgattctt gtacctcagc ctcccgagta gctgggataa
 9181    taggcatgag ccactgcacc cagccagcct atattattgt ctacagctgt taaataggca
 9241    atcattgagt gaatgaataa aagctagcac attctcagca aatcaaagaa gccgtgtgct
 9301    tttcctcatg aaaatcaact ttttttatt ttttgagaca gagtttgctt tgtcgcccag
 9361    gctggagtac aatggcacga cctcagctca ctgcaacctc cacctgccag gttcaagcga
 9421    ttctcctgcc tcagcctccc gagtagctgg gattacaggc gctcgccaac atgccggtct
 9481    aattttttt attttagta gagatggcgt tcaccatgt tggccaggct gggcttgaac
 9541    tccttacctc aggtgatcca cctgcctggg cctcccaaag tgctggatt acaggagtga
 9601    gccaccgtgc caggccgaaa atcagcttct taatcaaaat aatcaaacag ctccaatttc
 9661    aaaattaatc actaaagaat tttttctga ggatccgaga gctttacaaa cactRaaggg
 9721    ccaaaactcc tctaaaaaca gcaagcacca agaaaagtct tgtactagga gggatgttgg
 9781    cagtgtctca agggttagag ggggaggctg gaaggaaatg ctggtgctaa agggaaggac
 9841    tgctgtttca ggagcctgac cttgagctta tttaccatgg cctcattgtc cctctccaga
 9901    ggataatggc tgattaatga ggcagtgttg gtaagtctga ggcttcctgg agagaaaagc
 9961    agagggcaaa tcaaacccca gagaggattc attataacat ccaacaggcc cactcagttc
10021    tctctcaaga aggcctttct acaaaacagc taagaacctc tccaccctgt ttcactgtca
10081    cagaggagta aaatggctct gtccctacag gcaacatatc aacatatcta gcacaatgtt
10141    tgctcacaaa cacagaacta attataagaa atgtgaaaga acctgaaacg caggggaat
10201    actcttactg gagacagcct ccatagtggt agaaaacata gtagatctgg tgttgaaagc
10261    ccctggaggg gtgatggtc acttactagc tatgtggctt aatgcaagtc acagaggcaa
10321    attactgaga accaagctag ggtcggatca gctctaaagt acctttcag ggccaggcac
10381    agttgctcat gcttgtaatc ccggcacttt tggaggccaa gatgggagga tcacttgagc
10441    caaggaattt gagaccagcg tgggcaacat agtgagaacc tgtctaaaaa aaaaaataat
10501    aataatat atatatat atatagtg tgtgtgtgtg tatatatata tatatatttg
10561    cctattcatc tatctataga tagataaata aatagatata tatcaaaaaa agaaaattgg
10621    ctaggcatgg cggttatgtg tctgtagtcc tggcaacttg ggaggctgag gtgggaggat
10681    cacttgagcc caggagtttg gggttacagt gagctatgat catgccactg cactctagcc
10741    tgggcaacag agtgagaccc tgtctctaaa aaataaaat aaagtacctt tccacttcca
10801    aaaattccca tgattctttc cacaggatac cattctcaac aacaaatctt gtagtagaac
10861    ttgtctcctc agaatctggt caaaacatca ctagttaggg tgttctttca aaaaaaatag
10921    caaatctcct agaaacaggc acattgtgtg ttaccctatt aggacccatc cccaaagcga
```

FIGURE 4-D

```
10981   ggcacatgtg ggtgcttcat taatactctg ttgaaaggag gaggtccttg gaaactggta
11041   gtaccaactt agcatggcat acaatgaaag gtgattggag ccacactcga ggaactacaa
11101   ggcagctttt cataaataaa agccacaaaa tgcaatttat aactcatct gtctaaacag
11161   actaaagaaa agtagctttc tatacctagg tcttcacccc ttctcctccc cacctctcta
11221   ctttatcatc cctgtcctac acagcactga gacccgtctt tctggttcca ggtccacttt
11281   tcctttttcc acaccagaat gcctttaatc actgatagaa atgaacaaac atgaatatga
11341   gttctaaaca ggaagacaga tagcctcaag aaccaacttg tcaatatgtt actaataagt
11401   gaaataagtg ggaatggtgt ctaacatggg catgataaaa taaaacccta aaatacatac
11461   tgtgctaggg atttgaacaa acttcaggat ttttaaggaa ggctgtgtct cacatctcaa
11521   ttaatcttcc caaaagaacc ctaagaggca aggtttattc caatttata aattaggaac
11581   gtaaggctca gtaaaaagaa aatacctgcc tcaaggtcga ctggtaaggc tgcagagcca
11641   gaactcaaag agatgtcttc taaatccagt gctctctcca gcacatctca gctacatcct
11701   ctatctttct catcagtata ggtcttcatg tatacaaagc atttctgcat tcattgttca
11761   cactgcttct gccacagctc atgaaaagga caatgcagat gtctaaatgg caccagatct
11821   atacccacct ttttttttt tttttttttg agacagggtc ttgctctgtc acccaggctg
11881   gagtgcagtg gcataatcat agctcgctgc aacctcaaac ttctgggctc aagtgatcct
11941   cccgcctcag ccttacaagt agctgctgct acaacaggca cgcgccacca cgcctggcta
12001   tttttaattt ttagtagcga tgaagtctcg ctatgttgcc taggctggtc tcaaacacct
12061   gggctcaagc gatctgcctg cattgacctc ccaaagtgtt ggaattaaac ggtgtgagcc
12121   accgtgctgt cctatccaca ctttaaaga tgctaataaa taacgtgatc accatcagag
12181   aaaataaatc ctacgtatct ggcatcactg agaagtacaa aatttcacac aagcaatttt
12241   cctactaact gaaatttatc ccttttaagg caaagctctt tctttatatc aaaacatatt
12301   ctccaaaata cataagatat gttactcttt acttagaatt aatgaaattt aatcagggat
12361   attcgactat aaacatgata taaacatcct acatactgtg ctaggaattc aaagattttt
12421   tttttttttt ttgagacaag gtctcactct gctgcccagg ctggagtgca gtggtgcaat
12481   ctcagctcac tgcaacctcc acctcccagg ctcaagtgat cctccctacc tcagcctccc
12541   aagtagctgg ggctaccggt gtgcaggacc atgcccagct agttttgtac tttttgtaga
12601   gatggagttt tgccatttgc ccaagctggt ctcaaactct tgagctcaag cgatcagccc
12661   accttggcct cccaaagtgc tgggattaca agtgtgagcc actgtgcctg gcccaagggt
12721   aaatctttaa acttgagttt ataatcttgt agaggaagag acacatctgt aaccataata
12781   tgaagccaaa gaacatgggc ttggggtgtg ctgaaaggaa ggtaagataa cacaagcaag
12841   gctagtgggg accaacaacc cagggtgact tactgaagag aagtgggagg cactgaaaag
12901   tcctgggcag gagaatggta tactacttgt gctttttgaa aagatgactc tagcacaaca
12961   gtgaggccag aggcagaaaa tggacttagg tggcagcgac agaggtagag agaaaactgc
13021   actgccaggg caggggcagt aggaactaaa acaggtggct ctgaaaggca ttacagacgt
13081   agagacaatg ctcttagcat ataggggcgt gggaaaggtg gggagctaaa gagaacacta
13141   agattcttgc tttcatggaa agatttcaga acgagaaaat aagagtaggt actggtttaa
13201   aggagcgtga gggactaact caggatggga tgatggggaa tgctttatag aggaagtgac
13261   atttaagcta gatattaaaa tatgagcagg ataagtagag tttcaccaaa aagtaaaaaa
13321   gcattctagg cagagaaaac agcacatgca aagacagacc atattacagt tgaacaatgg
13381   catgcagttt tagggaggtg catcagatga taagaagggt aataagtaag gccaggggcg
13441   gtggctcacg cctgtaatcc cagcactttg ggaggccaag gcaggtggat catgaggtca
13501   ggagattgag accatcctgg ccaacatggt gaaaccccgt ctctactaaa aacacaaaaa
13561   ttagctgggt gtggtcacat gcctgtaatc ccagctactc aggaggctga ggcaggagaa
13621   tcatttgaac ccaggaggtg gaggttgcag tgagccgaga tcatgccact gcactccagt
13681   ctggtgtgct ccagtcagag caagactcca tctcaaaaaa aaaacaagg gtaagtaata
13741   ttaaattgtg aggcacttgc ctcatactaa gaaattgtag gtgatgagaa gacaatcaag
13801   gtttctaaag gaagagggta aaggggagca gcatgatcag ggctatgttt cagaagggaa
13861   actgtataaa gtacagactg gaatggtaag acacaggagg aaggcaatag agcataatgg
13921   ctaagattac aaggtctgaa cttaagacaa cctaatacaa attctgggtt tatagcttaa
13981   tagctctgca accttgggca agttatttac tctctctgtg ccctcatttt ccccagctgt
14041   aaaatgggaa taataatagt actttatcag gcacaagcca ccacacctgg ctatttatt
14101   tttaattttt gtagagacag gatcttgcta tgttgtccaa gctggtctcg aactcctcaa
14161   ctaaagtgaa gctcccacct tgtcctccca gagcactggg ataacaggta tgagccactg
14221   tgcccagccc atagttccta attcgccctt tttgtattt attaatttat ctttctctta
14281   ctgccttaag ttccatgaaa tcacaaactg tgtgctcacc gctgaattct tagaaatcag
14341   cacaatggct ggcacagcat gagtgcttga taaatacttc ttgaatgaat gaaaggttcc
14401   aaactatata ttttaaatga actctattta aatgtaacct ttatatagaa ccccaggaca
14461   cacagaagaa gacagtttga agtaagggat atttggagac ttgttccctc tgcttccccc
14521   tggttcttaa gtcagttcta tagttctgta aagcttaca gaatgcagtg caaaaaccat
14581   tgtctgttac aagcaagaag taatgtatgt ctgaagtaag gcaatgacaa taaagatgca
14641   acaatagctt tgagaactat ttatgacagg ccctgacaac caattacagt aggccctctg
```

FIGURE 4-E

```
14701   tatccatggg ttccacatgt gtggattcaa ccaacctgag atgaaaaaca ttttRgggaa
14761   aaaaaagcat ctgtactgaa gatgtataaa cttttttttc ttgtcattat tctaaacaat
14821   acaatgtaac aactatttac atagtattta cattgcatta tataagtaat ccaaggatga
14881   tttaaactat acgaaggacg tgtgaaggtt atatgctaat attataccat tttatataga
14941   gacttgagca tccaaggatt ttggtatctg tgtgaagtcc tggaaccaat ccccacagat
15001   gctgagggac aactgtataa atgaagaatg agaaaaggaa aattcttgaa gcacctctaa
15061   atttcctagc ttgagtgaac aaataaatga acatgtgtgc caaaaagcaa gataagaatg
15121   taagagtggc tgggcacggt ggctcacgtt gtaatccca gcactttggc aggtcaaggc
15181   aggtggatcg cttgaggcca ggagttcgag accagcctgg ccaacatggt gaaaccctgt
15241   ctccactaaa aatacaaaaa aattagccgg gcacggtggc aggcacctgt aatcccagct
15301   acgagggagg ctgaggcagg agaattgctc aaacccagga ggtggaggtt gcagttagcc
15361   aagatcacac aattgcaatc caccctggga aacaagagca aaactccatc tcaaaaaaaa
15421   aaaaaatgta agagtaacaa taacaatttc cattcatttg aacatagtat caccctatc
15481   aagcaaatac tattaatacc ctcaagttat agaataaatc tttcacgatg ttaagcaact
15541   gtcatgatct tcattagcaa agatcatgag gctaataagt agcagaatta agtttcaaat
15601   ccaagactgt cccactccaa gcccaaaatc taaaccgtct tgctatattg gcaagcagtt
15661   tgagagttag gtcttagacg tgagatatct actggatata cagttagaaa taatcagtaa
15721   ctaatgaaaa atatgatttg gggttagaga taaggatctg ggctccattt ggaagactga
15781   ataaattcag aagagtgtct atgagaagat catgcttgct tgtaaggcct gtaaatgggt
15841   gatgtacgca tttgcgattg aagtttgttg atttaccaag gtctctgcct tgcatagatc
15901   tagtgggcat cRgcattaag agaggaagta aaaaacttta ggagaaattc cagatctctg
15961   gggattcctg ttaggacctt tatattattt ttgttttggg agaatttaac agaaagacag
16021   tgacaccaat gtcaacaaaa aaaatgaga cagcaaaggt gataaagaga atagatttgg
16081   ggatcatcat tttctcttct gcttgagatt ccacagctct caacaaaaat gactattatt
16141   tgtgtatggc tctttacaac taacaaagtg tttcccattt acaaggtatt tcctgtttac
16201   caataatgtc agatgaacct tacaacagct gtttaaggtg agggcattat tattttcact
16261   ttaccaaaga ggaatgaagt ccagaaaagt taagtttacc ttgtctaagg tcatacagct
16321   aaaaagcaac cgggccacga tgtaaccacg gttttctggc tcctaatctg gggctctttc
16381   cagaagactc acctgagata acatgagcca ctcacttatg aaccaagagt catcatccct
16441   atgtatagtt tcactgtgtt taaaaataaa acaataggg gatagtgact gggaaggggc
16501   taatggtatg ctggtaatgt tctgtttctt gatgtaggtg ctagtaacac aggtgtgttc
16561   accttgtgga aagtccttga gctgtaaact ttgtgtactt ttctgtatat atgtcatact
16621   gtaattatta aataccaggc aagccaggtc aggaggcttg cacttgtaat ccaatggct
16681   caggaggctg agatgggagg atcacttgag cccaggaatt caagaccagc ctgggtgaca
16741   aagcaagacc cccatctctc aaaaaaaaaa aaaattcagc tgggcgcgga agcttacacc
16801   tgtaatctta gcactttgag aggccgaggc agacagatta cctgaggcca ggagttcgag
16861   atcagcctga ccaacatggt aaaaccacat ctctactaaa aatacacata cacacacaca
16921   cacacacaca cacacacaca caattagcca ggtgtggtgg tgcacgccta taatcccagc
16981   tactcagaag gctgaggcac aagaattgct gaacctgga aggtggaggc tgcagtgagc
17041   tgagatcata ccagttcact ccagcctggg tgacagagtg agactctgtc tcaagagaaa
17101   caacaacaaa taaaaaaaaa ttagccaggt atggtggcat gcctgaagtc tcagctactc
17161   aggaggctaa ggcaggagga tcacttgagc tcaggagttt gaggcttcag tgagctacga
17221   ttgtgccact gtacccagc ctgagtgacg cagcaagatc ccatctctct tttttttttt
17281   ttgagttgga gttttactct tgttgcccag gctagagtgc agtggtgtga tcttggctca
17341   ttgcaacctc cgccttccag tttcaagcga ttctcctgcc tcaacctgcc aagtagctgg
17401   gattccaggt gtctaccacc accccagct aatttttgta ttttagtag ggacaggggtt
17461   ttactatgtt ggccaggctg gtcttgaact cctcaccttg tgatccgcct gcctcagcct
17521   cccaaagtgc tgggattact ggcatgagcc atcgcgcctg accaagatcc catctcttta
17581   aaaaaaaaaa aaaaaaaaaa aaaaggcaag ccaaactgat aatcaaaact caggaacact
17641   aagttggatg cgtcacattt tttactcaat ttctcaaaca gtagctacat ataggacatc
17701   taccagttat ataaggatgt acaaaattct tgcacactca aataacatat ccacccaatt
17761   gtcccaatcc agactgtctt agtgatgtga aagaatctga caggactgga agtaacagaa
17821   gcccaggaaa gggcggagat ttttgttaat gaaaacaaaa atggcattga aaatggaact
17881   atcctacatc atcatcaatg atgagatatc tcaatttcag agataacaaa aatgtgaaaa
17941   aaaaatggcc agtgacaatt ggaagatact atcaattgta aaatacaccc caatttcagt
18001   gttaaaatat taaaaaagca aaaaaaaaaa aagaaagaa agcattttaa aacaaaggaa
18061   atatattcta atctcaaaag gtagctcaat tgtgggataa cagatttgtg aagcacatct
18121   ccttgtacaa gctctttgtt ttagagataa ggacactaaa gccttcattt aagttattaa
18181   ataaccttac taaattaaag ctcacatcatc agaaagttga taactacaat tacaaagctg
18241   gttccttcaa tgctcgttct cctgccacta cccagatgcc tcctttaaat ccaaaagaag
18301   atttacatat taattccata ttaaaactct attttgactt tcatatttct ttacttcatt
18361   aactcactaa aaaataataa aagttaacct ttaaaaatca attaaagctg ggcgaggtgg
```

FIGURE 4-F

```
18421   ctcatgccta taatcccagc actttggaag gctgaggcag gtggatcact tgaggtcagg
18481   agttccagac cagcctggcc aacatggtga aaccccatct ctactaaaaa tacaaaaatc
18541   agttgggcat ggtggcaggc gcctgtattc ccagctactt gggaggctga ggcatgagaa
18601   ttgcttgaac ccgggaggtg gaggttgcag tgagccaaga ttgcaccact gtactccagc
18661   ctaagaaaca gagcgagaca ccgtctcaaa aaaaaacaaa aaaaaacaaa aaacaaaaaa
18721   acaaaaaact aagctgggtg cggtggctca cgcctgtaat cccagcactt tgggaggctg
18781   aggcaggtgg atcgcctgag gcaggagtt  tgagaacagc ctggccaaca tagtgaaacc
18841   ctgtctctat taaaaaaaaa aaaaaatagc taggcgtggt agcaggcgcc tgtaatccca
18901   gctactaggg aggctgaggc agaagaatca cttgaaccca ggaggtggag gttgcagtga
18961   gccaagattg tgccactgca ttacagcctg gcaacaaga  gcaaaactac atctcaaaaa
19021   aaaacataat aataattaat taagatgaaa cgatgtttag gaaacttcat ttcttgctta
19081   tacaagtttg ttttccttgt tcttcaaaac cagtgaagca atacaaagtt agataaaaga
19141   caaaattagt aatctcccag ccccctttcca ttcctctcca aggcctccta caagatgaga
19201   aatggtaaca tatttttgtg tccccccaaaa acataaatac aaatatattg gaaagggttt
19261   tgttgttctc tgttttttaga aaactaggtt taaactttac acattgctct gcaacttatc
19321   tcatctaaca atttatcaac atctccccaa gcatcaataa ctaaaattct aactcatact
19381   tttaaaaagc tacataaaag tccatataag ggatatccat aacgtgttca catattttttc
19441   tattgaggga atggctattt tcagtgttac catttcaaac aatgctgtaa tgagtatcct
19501   tgacgtattt caagttaaag aaaaaaaact atttctacac acatactttc cttgtttgtcc
19561   catgttttga ttactcctgg tctcatcatc atccctacct cccttgctca gagaatcatc
19621   ctcagggtcc agtgtgatga cagagagcaa agtaacttgg agaatgtcaa gacaagacat
19681   gtgatagtta ctgttggtaa attggaaatg gcctgtcttg gctgcctctc tcagtcactt
19741   gcacatgcta tcccctcct  ccccttacat gtgctccctg ttctggtctc agcagctgct
19801   tccaactcaa ctgatgtgag cacagctagc tacYttgtca cactcctaaY cctggcaagt
19861   gcagacaggc ccaggagctc tccaaacaat tggaaaggag aaggaataca ttatcactgt
19921   gaaataatat aatacggagg tatctagagt aaaatgtaaa actccctctt cattaagcct
19981   caacccacat ttgccagtga cactccccag ctcagaagtg accactgtta gaagtctgtt
20041   gtacaacctt ttggattttt cctaagcatg tacacataca ggtatatatt cacatacagg
20101   tatgtgtgtt tggtctacat atctgtaatc ataccatata atatgttctg caacttgccc
20161   ttttcatgta Maaatttatt tgacatgttt ccataccagc aaaaaacaga ttcctcacat
20221   ttttaattaa tttttttga  gacaaagtct cactctgtca cccaggctgg agtgcagtgg
20281   caccatcatg gctcactgca acctcaacca cctgggctca ggtgatcctc ccacctcagc
20341   ctcctggtag ctgggactaa aggtgcgcac caccataccc agctaattta tttgtagaga
20401   tggggatttca ccatgttgcc caaactgttc tcaaactcct aggctcaaac aatccgccca
20461   ccttgtcctc ccaaagtgct gggattacag gtgtgagctR tcatgctgg caattcctta
20521   aactttttaaa agcttRaaaa aatcctatgt aagaatgtgc cacaacttta ttttcccatt
20581   ttgctacatc tggacattta ggttgttcac agtgttttgc atgtcaaaga atgctgtatt
20641   gataacactg gcagcacatc tctaattta  cacacaagct aatatttctc taggatatat
20701   accaataatt agaattaatg ggttgaaaag cttgtgtatt ttaaatgtca acagatattc
20761   ccaaattacc atctaaaact gtgtactagt ttatagtctc accaacagag gataaaaatt
20821   cccatctaca cccttctacc aatatatttt atcaatatat aagatagaat atattattgt
20881   tttaatttat atcttatttc cagaaaagtt aaacatctcc tcacatatgc aactgttcat
20941   tcttatttct tatgaaaggt attaccattt tgattttaaa catgagggtt cagagatgct
21001   agagtgacac aaccagtaag tccagacatc aaagctgttt ttttaacaat tcccatcaa
21061   aactaggcct ctttctgtca agtgtaattc ccctaccag  cagccagcaa actatggcct
21121   ataagttagc agcccatatt ttgtaaatca ggttttacta aaacgtagcc acgcccattc
21181   atttaagtat tgtctatggc tgctttttgtt ctccaatggc agaggtgagt agttacaacc
21241   acatggtctg caaagcctaa aatatttact actggggtct aaacagaaac aataacttgc
21301   ctaagcacag tgactcacac ctgtaatccc agtgctttgg gaggctgaag gtggtggact
21361   gcttgctgtt tgagcccagg agttcgagac caacctgggc aacatggcga gattccatct
21421   ctacaaaaat tagaaaaata gccagttgtg gtggcatgca cctgtaatcc cagatactca
21481   ggaggctgag gtgggaggac tgcttgagcc tgggaggcca aggccgtggt gaactgccat
21541   tgtgccacca cattccagcc tggaagacag agtgagactc catgtcgaaa aaacaaacg
21601   cacacacaca aaaaaaacaa gagttaaaaa ctaagaaaaa gctcaggtct gggcacagtg
21661   gctcatgcct gcaatcccag tacttaggaa ggcttagcga acccccatct ctacaaaaaa
21721   taaaaaaaat taggctaggc acggtagccc acacctgtaa tcccagcatt tgggaggcc
21781   gaggcgggcg gatcacgagg tcaggagaat cgagactgtc ctggccaaca tggtgaaacc
21841   ccatctctac taaaaataca aaaattagct ggccgtggtg gcgtgtgcct gtaatcccag
21901   ctactcagga ggctgaggca ggagatcact tgaaccaagg agttggaggc tgcagtgagc
21961   cgagatcgtg ccactgcact ccagcctggc gacagagcaa gactgtctaa aaaaatttaa
22021   aaaattaaaa attagccagg cacagtgctg tgtgcctgta gttccagcta cttgggaggc
22081   tgaggcagga ggacccctttg aaccaaggag ttcgaggttg cagtgagcta tgatcacacc
```

FIGURE 4-G

```
22141    acggcactcc aaaatctggg tgatagagca agaccctgtc tcaaaacaaa aaaagaaaag
22201    cttctcagtg gggattagtt atggtctaat tggccacagc cagagcatgg ctatgttaca
22261    gtgtgtggct cattttcaaa taactttata tgcagtatag gtctggtata taatcccaaa
22321    ggaaagagcc caaaacactc aaatgaagtc aaaagactta tctttactta tggggttgcaa
22381    cactaaaaga ttttctatgc actactcttc gtcttccttg tttctttttct ttttttttt
22441    tttttttttt ttgagacaga gcctcattct gttgcccagg ctggagtgca gcggtacaat
22501    cacagtttac cacagcctca acctcccagg ctcaagcgat cctccttcct cagactcctg
22561    agtagctggg accacaggca ggtaccacca cacctggcta attttgtat ttttgtaga
22621    gacagggcct tgtcatgttg cctaagctca tctcaaactc ctgggctcaa gtaatcctgc
22681    ctctgcctcc caaagtgctg ggattatagg catgagccac catgcctggc cccttattta
22741    atttcatctg gttcctactg tccttcaatg attttgacaa tgtagttcct acccacacac
22801    cacaataata caaaaccaaa gcaaactcca ctatgtctgc tgctaaacac ccccaacaaa
22861    cacacataca catcacacca caccacacaa cacaacacag gtgtctcctt cccttttgct
22921    agcagattcg ctaggaagca gctgcacatt tccagcaagt cgaacaaact gctgagagct
22981    agggcccctg accattgtgg gaaggaagg ccaattctcc cctctagatt gtaccttct
23041    gaagatcctg gccatgaaag aagtcatttc tccagagaat tttaagccat tcagttccta
23101    tacggcaggc aggaaaggtg tcatcctccc catatcatca gtggaggaac tcagtgtaac
23161    ttgtttcatt tcctcttact tcaaaaSgtc attttaagta ataggggtcat ttaggtaata
23221    tcagtgatct ttttaatttc tcctcgcatt ctctcccaaa ttttggtttt acaaaataat
23281    ggttaaaaaa aaaaagctat catactctcc acgaaattta acttaatcta gaattttgaa
23341    tgagaaatta ataatcaaag aacagtgcat tttaggccag gcgcggtggc tcactcctgt
23401    aatcccagca ctttgggagg ccaaggcgag cagatcacct gaggtcagga gtttgagacc
23461    agcctggcca acatggtgaa acccccatctc tacttaaaat acaaaaaagt agctgggtgt
23521    ggtggtacgc acctgtaatc ccagctactt gggaggctga ggcaggagaa tcgcttgaac
23581    ctgggaggtg gaggttgcag tgagccgaga tcgtgccatt gcactccaga ctgggggaca
23641    agagtgagac ttcgtctcaa aaaacaaaca agaacagtg cattttctta cacaaataag
23701    caggtattaa gtggttctct ggataggaat ttggcaatac aaatcaaaat taatgcctat
23761    aatcctagca ctttgggagg ccaaggtggg cggatcacct gaggtcaaga gtttgaaacc
23821    agcctgacca acatggagaa acccgtctta aaaaatcaca aaattagctg ggcgtggtgg
23881    cacatgcctg tcatcctagc tactcgggag gctgaggcag gagaatcact tgaacctgga
23941    acaggtggag gttgcagtga gctgagattg tgccattgca ctccagcctg gcaacaaga
24001    gcgaaactcc atctcaaaaa caaaacaaaa ccttgatatt tgggccaggt gtggtggtgg
24061    cacatgccca aaatcccagc acttgggag gctgaggtga aaggattgct tgagcccagg
24121    agttcaagac cagcctgggc aacatagtga gacctcatct ctacaaaaaa taaaaaatta
24181    gccaggcatg gtggtgcaca cctgtggtcc cagttactcg ggaggctgat gtgagaggat
24241    cacttgaacc ctgaaaggtt gaggctgtgg tgagctgtga tcataccact gcactctagc
24301    ctgggtgaca gagtgagacc ctgtctcaaa acaaagaaac aaagaaacaa aatgttcat
24361    atttggctgg gtatggtggc tcacacctgc actttgagag gccgaggcag gatgatctct
24421    tgaagtcagg agttcaagac cagcaatctt ctcgcctcag cctcccaaag tgctggtgct
24481    aggatgatgg gtgtgagcca ctgcacccag cctaagatag taaattttgt tacatacatc
24541    ttaccaaaac tcaaaaaaaa aaaaaaaaa aaaaagctgg ctgggtacaa tggttgaagc
24601    ctgtcatccc agcactttgg gaggccaagg taggaggatt gcttgagccc aggagttcaa
24661    gaccagcctg gcaacacag tgagaccatg tctctacaaa aaatttaaaa attagccagg
24721    tgtggtggca tacacctata gtcccagcta ctcaggaggc taaggtggga ggatcacttg
24781    agtctgagcc tgggaggctg aagccataat aagctgtgat cataccactg cactctagcc
24841    tgggcaacag agtgagatct tgtgtcaaaa aaaaaaaaa aagaaacaaa aagaattaaa
24901    aaaaaaaaaa tctcatgttc tttcatcaaa taattccaat cacagaaata aagtttagg
24961    aaataatctg aaatacaaag atatatggac attaatagaa ttatttatca ttctgaaaaa
25021    ctgaaggaaa actaaatatc taacaataac ttaaattatg gcaagaatat acatatgatg
25081    aaatcttatg cagtcactta aaatgtttta aataagtttg gctgggtaca gtggctcacg
25141    tctataattc cagcactttg gaaggctgag gtgggatgat tgcttaagcc caggagttca
25201    agaccagcct gggcaacata gtagactcca cttctacaaa aaataaaaat aaaaaaaata
25261    gctgggcatg atggcatgcg cctgtagtYc agctacttgg gaagctaaag cgggaagatc
25321    acttgagccc aggaggtcaa ggctgcagtg agctaggatt gcaactgtac cactgcactc
25381    cagcctgagt gacagagcaa ggccccgtct ctgggaaaa aaaaaaagt tttaaataat
25441    tttaatgaca tggggaaata ctcaagaaaK gttgaatttt aaaagcagga tataggctgg
25501    gtgcagtggc atatgcctgt aatcccagcc ctttgggagg ccaaggcagg tgaatcgctt
25561    gggctcagga gttcaagacc agcctgggca acatggtgaa accctgcctc tacaaaaaat
25621    acaaaaatta gccgggcatg gtggcatgca cctgtagtcc tagctatttg ggaggctgag
25681    gtaggaggat tgcttgagcc cagaaggttg aggctgcagt gagctgtgat cgtaccactg
25741    cactgaagcc tgggtgagag agtgagaccc tgtctcaaaa caaacaaaca aaaaaaggc
25801    aggataaaac tattatggta tggccccatt tttgaaacta tatatacaaa tatttataga
```

FIGURE 4-H

```
25861  cagatagata tatcatatac atatttatcc ctctccccac atacttgtga gtttgtatat
25921  gtgtatgtat acgtgtaagg aagtatacca aataatgttc atttctgagt tgtggaatta
25981  tgggtgcctt ttactttccc ccttaacaca ttattttca tgttttctaa atagtaccat
26041  catatacaat taggaaaaaa ttactttcat attgtttaat ctagtaatct atttgtagat
26101  atgtatcata agaaaataac caaaaacgta gacaaaaact tatgcataat aatgttcata
26161  taaagataca cagaaaacta ttaataaata atggttactt ctgcagggca gaattagggt
26221  aaagacttat ttggggactt atttgttata tctattacaa aaatgatttg aaaaaaattc
26281  cattattatt tgaaaaaacc tgaaagcata taaaaatcct atatgataga ctattatgca
26341  gccactacaa atatttatga agagtatata taaatttata taatgaaaaa atggtaaatg
26401  gggaaaaaag cagaatataa aattttaggt aatatatgat ctggaaattg caaaaccaga
26461  aatatacaag cacaaaatac tgaaagaaaa taggctaaaa taagaacagt agttttctcc
26521  agatagtggg attacgggtg atttcagttt tcttccttat acttctctgc gttttcaca
26581  tatcctagaa tgaatatata ctattttca atcaggctta aaaatgttt ttggtttctg
26641  ccctataatg aaaagcctgc tccttgtgtg aaatttatc cacaaggat tatcagtagt
26701  aagcaaccca ctagcaagaa gactgttcat aatgtatatg cctaagaaaa tcatctttgg
26761  tgggtcagtg agctcagttt aaagggacac agctctgacc acttcctgcc ttcttgcttt
26821  tggagttgtt ttagtaaata taactgagga atcaagttct caaacatgag atgcctgaca
26881  aacttaatac tgtactgtaa gaaccaggac caccaccttc tcaaccta acctctaaga
26941  ctttacactt aagaatagac aagaccgggc cgggcgtggt ggctcatgcc tgtaatccca
27001  gcactttggg aggccgaggt gggcggatta cctgaggtca ggagtttgag accagcctga
27061  ccaacatgga gaaaccccat ctctactaaa aatacaaaaa ttagccgggc gtggtggcac
27121  atgcctgtat tcccagctac tcgggaggct gaggcaggag aatcgcttga acccaggagg
27181  cgggggttgc ggtgagccga gatcacgcct atagcctggg caacaagagc gaaactctgc
27241  tcaagaaaaa aaaaaaaaa gaatagacag gacctaaata acatagattg ggtcatgtta
27301  gtctgtaaat caaaaacact taacagctaa ttacatgaag aataaaatcc aaatttctta
27361  gcataacgct taaggttctc taagatccaa ccctcaaatt tccttcccag cctcatcttc
27421  agttcattcc ctaaaatatc ctctacctca ggcacatttt ccccatacat gccaggcatt
27481  ttccaagctg tgtgcctttg cccatggtgt gacctccatt aaatgccctg tctcctaaac
27541  ctactgaact cctattcttc ctttacaacc tggctcaaat gccttctccc aaactctcct
27601  tatcgccccc accatcagga acaattgttc tttcctctat gtgctcccat attgcttgtt
27661  cctctacaaa cttaattaca atcctccctg ggtggatgct agctgtaata cttgtttcat
27721  tttactaaac tcctggaggg cagaaaccat tttaaaatca tttccactcc agcacactgc
27781  ttgcacacag taggtactaa atatgctgcc tgagtaaatg acagccaatt ggcccttatc
27841  tgaattcttt cagtggtaca gccagggatg gcaaattgtc aaagctagtc cctctaattg
27901  caagttatac atatagcatg agtgaccagc agaaaatgcc aagggcctgc cactttaaga
27961  ggactggcaa gatgactatg tttacacaat cctaattaaa actaaagggc aatgagggaa
28021  agaagagaaa tagggagatt aagaggtgtg gattctacag gtcacctcct cttcttagtg
28081  agcttgctag gcactaggct ggaagatctg agctacaaag tagcctattt tatctttggg
28141  gtagcctgta ggatctaagt attgaaaagc aactaattag gccactttgt cctccagcaa
28201  ctggccctgc tcttgggcat taacttccaa ctggtacaca aggcttttc tctaaatgaa
28261  tcccactgta ccaatcacta ggagaatccc tttaaaaaag gcttgaaatt aataacagca
28321  ggaaacaaag tctctcaatc ctctgaatca caatatccac actgtccatt ttgatgaaat
28381  tcaccccac ctccttcaaa caataggtcc taccaaggaa tgacttctct caggaccaac
28441  atgtcctgtg attgtttttc tggagcaagc ttccagtgcc tgcttctcat taaatagcta
28501  cttaatgtct gatcacccag ctgtgactat aagtagagag taaagtaact ataatttagg
28561  aagtaaaaaa gaaattccac tcctacccca agtccagtag tcaaacagct tagaatagac
28621  atttccctac ctcaaacctt cttaggctta tccaattttc agatctagaa ttttagcat
28681  ctcttaactc tttcaatata aaaatgagga aaacaatgtY tagagtaaga aagagaattg
28741  caaatgatta tacagtaact tagtcacaga atcttttgac caggctgtct aacacctcat
28801  ttaactgatg agttttcaag accactgttt ccaggaacag gttacagggc actacaatat
28861  aatcagctta atttgcatat attcaagata acagccccta ggcttgaccc cttcaccatc
28921  ttcctgccta cctttttca aacccacaac tgctaacaac aacaaaaaaa tcaatgtagt
28981  gatttaatac atcatttctg cctaaaaaaa gactggagct accaaaccat ctgcttcagc
29041  ctcaccacct gggattcatc ttgattgatt tgggtgtgtt ggtgggcagt ggctgccaca
29101  gcctgaagaa ctcttccaac tctttctggg ggtcttctgg agatgggact gcaatggctc
29161  ctcagctgca gtttcctata gagcaacatg ttgaaacaca cttgttccct caacacactt
29221  gtgtttcagc cctcaacaca cttgtgattt gggaggagta ccaggagaaa gaccagtttt
29281  tgcagggcg cggtggctca cgcctgtaat cctagcactt gggcggcca aggcgggtgg
29341  atcgcttgag gtcaggagtt caagaccagc ctgaccaaca tggtgaaacc ctgtctctac
29401  taaaaataca aaaaattagc tgggcatggt ggcacatgcc tgtaatcata gctactaggg
29461  aggctgaggc aggagaatcg cttgaacccg agaggtggag gttgcagtga gctgagatcc
29521  cgccattgca ctccagtctg ggtgacagag agagaccctg tctggRaaaa aaaaagaaaa
```

FIGURE 4-I

```
29581    gaaaggccag ttttctccat tatctagtca ccccaaccta taagcaagca tatgcacagt
29641    cactataaag gaaagtgact tgttttccag cagacatttc taatcttatt aaatcaaatg
29701    aaaactgcaa tcaaaatact ctccttagga agttatttac ttattctaac aaaacacttc
29761    tttgggagct gcctttaaag tctactccat gtgagacaaa cagaaaaatt cggtgttact
29821    gttttatagt cacacctcat ccttcaccaa aaaaggtatt gccttgcatg aatctttggc
29881    tcacggcatc ttctggctgt ttctaaaaat tgaatccacc aagctaagag taaagatttg
29941    ctacctctga ggatattcaa aagattggct cagaggcagt ctgaggcaat gacaccatca
30001    ccaaaggaaa tctaaaggct gagaacacaa ttactttgaa ggggtcaaac ttaaaaacat
30061    tctaattgcc ccataattac aatcaagggg gcaagacatg tacaatatct gtcacatttg
30121    ttcaactatt atatcacttt ataattacac attaYataat gataaatttt ggccctggaa
30181    gaaatcttca agatcatata atcctaactg tccctttta catatgagaa aagttcagtc
30241    cattgaggtt aggcaatttg tccctggtca cacatctggt tagcaacagt caggatgaga
30301    aacccagaca cccaaactcc cagcataatg cacccacaca tacttatgta tacagctcct
30361    cctccctgc ttctcacttc cttcactccc ctgatcaaaa gggacagaaa taacttggga
30421    cactaaagca caccaagaat ggttctgaaa cccagtagca gagaaatgat ggcttaaaaa
30481    ccaggacttc tctgcagtgg cctcaatggc caatgtttag tgtctggctc acaagagttc
30541    tgggcaatct acctcagagc aagggccaat gaaaacctct ggacaccacc ctcccacagt
30601    tagaaaaata tctttattaa acctctctgc tctcctccta cagtaacctg tttgcctcaa
30661    ataattgaaa gacaaagaca atcactttga agaatctggg tcagggaaaa agtaaatggt
30721    agagatcctg ctcaggacaa agctgaccta tSaaaaacta gagggcagaa accattttga
30781    cttacctcct ggtggaagcc tccacacact agaacaggt gatctccagc agtctggctt
30841    agaattagtt tccacctagg gaagggcaa agggacagga atgattattc attcccctaa
30901    cccacccact cttagtgagc tcagcctcac attatcctgg gcaacccag cgttctgtgg
30961    atcagacagc aagcagaagg gaagccatgc aggccaggtc aacggggtga gtcagtggca
31021    gagcaggaag agtcactggg gcagaaattc tggccttctg tggcaagact gccaagccac
31081    acccacactt ggtcagcact gtgaaggccc tgccctgtta ggatttcagt ctttaagcca
31141    gaaaacttct tcctcaggag gccccacacc actctcattt tcaagtgtct ctcctcctgc
31201    tcaaaaatct tccagttttc ttctccctaa agcatcatat ctaaattctt tggcttaact
31261    ttccaaatcc tccattatat ggcctcaagt catttattca accttatttc ccactattct
31321    acagaatata ctctgaattg atcaagccag tcttcccact tctctctgcg tgagccaagc
31381    cttttctcat ttccctgctt tcaattatcc aggagtggta aattcaaaca tcttcagggg
31441    tcaggcaggt aacagaaaca aattatccag gcaaggccca gtggctcaca gcggtaatcc
31501    cagcactttg ggaagccaag gtgggcagat cgcttgagct caggagttcc agaccaacct
31561    gggcaacata gtaaaactcc gtctctacaa aaatacaaaa aattagctag gtgtggtgga
31621    gtgtgcctgg gtcccaccca cttggcagtg tgcagtgagc tgagaccgtg ccactggact
31681    ccagcctggg caacagagcg aaaccacgta tccaaacaaa acaaaatgaa tgatccagtg
31741    gggcacatgg cagatctagg aaacgctgca cccccctaaa ggcattcaaa tattttaatt
31801    caaatattta tgtagtgtct cactgtgagc atcacgataa ccttttaaat agttattaat
31861    actctatctt gcaaatgaga aaacttcccc aaggttaggt aactggcaaa atgctgggca
31921    cagtctctag acctgtctga tgccaaagca agagctctac accattaggc ttctagcagt
31981    gcaaacacca tggaagatac agaaccctca aagtcacttt tcatgataca caaccttaat
32041    agtaggatgg gaagcccaaa tcacagctta tctaaccata tcccaactgc ctccaattct
32101    gttcattttc caaaccccat ctttctgcca aagtatttca ttcctagtta tccaagtcct
32161    actgaattcc ttcttctgta aattcctata gggtttatag attagacaac acaaataagt
32221    gctaaattat atactgtctt gcaaaatcag atactgcttc tatgtatttt agtgtcagcc
32281    tcatcaatca aactattgta ttaatctata tagttcttct accaaaaatg cctaacctga
32341    atctaatcaa gaagaatcag acaaatgcta tgaaagacaa aaaggcattc agattaaaaa
32401    agaactgttc aaagttaaag cagactaaag acatgatagt catgacaact aagtgcataa
32461    atacatgcat gatccttcaa tgaatctga attttaaaaa actcaataaa agacatcact
32521    gggaaaagat gagaaatctg aacaagtatt atatactgga tgtattgaat caatgttaag
32581    tttcctgagt gttaatagta ctgtagttat ataggaagat acctttttct taggaaatac
32641    ttgctgaaat agggattaaa taacatgata tttacatcta acagtcaaaa agattcagaa
32701    aatgaaggaY aaatagacag caaatttggc aaaatgttaa tagtgactct aaatgagaag
32761    tatataagta tttgttacat tatttgcaa aatatctata ggtttgaaaa ttttcaaaat
32821    aaaataattt agtaaggagg gaaatcctgt attatatact tttttatata ctcagctctg
32881    tgacagatat aataggcact cattacttta ggtatctgct cactacctaa ggaaactggg
32941    catttggagg tcaRcaatca gacagagtcc actttgctgc agctcatgag gggtatagta
33001    ggaaattctt agggaataag aggtttctcc aaaactcaca ttgtcacacc acaggaaatc
33061    tagaaaagca ggcaattacc tcactcctca ttgaggccat cacagaagta caggcactga
33121    acaaatgccc actcgctagg cagaatgcag ctgctgccca cacgttagta cccagtggta
33181    aggtggatac aatgtgacct cagaggacca agagttgagg tcacattgca tccacccttgc
33241    caccgggtac caaaaatttg acaatctgca aaacaagtgt ctctggccag tcacaggaag
```

FIGURE 4-J

```
33301     gcactcaagt atcaaataaa catgcctgaa atatatgcag tctttcctcc tcaccagata
33361     aaccagtcct cagctgcaat aaggcagaag aaatctgcaa ggctgaatca ctggtatttc
33421     ctgtgcagac ttcaaagaaa ctggcccttc aataggacag aaagggcagg cgacacagct
33481     gccaacagag gcctcaaccc aggagcatgc tatgcaataa tgccttctct cccttctaca
33541     gccatcagat acctcatttt tacttctgcc aaatggcccc ttattaccgc gactgattac
33601     ctaatagcca acccttttacc ttggttctct cctcccctca atgagaccca agatactggc
33661     cttctagac agctcctcct ccaatttgcc agaggaattg tcaaaactat tcccctggcc
33721     aggcRcggtg gctcacgcct gtaatcccag cactttggga ggccaaggcg ggcggatcac
33781     actgtcagga gatagagacc acggtgaaac cccgtctcta ctaaagatac aaaaaattag
33841     cYgggcgcgg tggcgggtgc ctgtagtccc agctactcgg gaggggaggc tgaggcagga
33901     gaatggcgtg aacctgggag gcggagcttg cagtgagccg agatcgcgcc actgcactca
33961     agcctgggtg acacagagcg agactccgtc tcaaaaaaaa aaaaaaaaaa aagctgccta
34021     ggccaggcac aatggcttac acccataaac ctagcacttt gcgaggccga ggcaggagga
34081     ttgcttgagc tcaggtgttc aagactagcc tgagcaacac agcaagacct tgtctctact
34141     aaaaatcaaa aaaattagcc gggtgtagtc ccagctacac tacctaggag gctgaggtgg
34201     gaagacagcc actgcactcc agcctgggtg acagagcgag accctgtctc aaaaaaaaaa
34261     aaaaaaaagt tgcccacagt aggaggtaga ggagaggcca ttattaagca cactctcagt
34321     aaaccatgaa tctgacagag ctacccaaaa catcaatgca gtcttaagct gcattagtag
34381     aagatgactc tatgccccac ctttgaagag caaagttaga ggacttgcag aggaagaaca
34441     ccaatgacca tggcaaaggg tctagaagta tatcatttca aatatggagg aagaactaca
34501     cacttttagc caggggagaa caagaaaact ttttttcaaat atacgcatag ctttcacata
34561     gatgaggaga aagacttatg agtccactat aagaatacaa aaccagaact aatgagtgga
34621     agttacagga agactgattt tggtttgcca cagggaagaa atttcagcat gttgtagaag
34681     ttcagaatgt gggatgtaga acccagaatg cttggattag gatgtcaact ccaccactta
34741     taaactgtgt ggctttgggg agattaatct acctgtgcct cagttgcctt ccctgtaaaa
34801     gagaatagta ataatagaac ttagctcaca gagctttaag aagtagcttc cgaggctggc
34861     tgcggtggat caggcctgta atcccagcac tttgggaggc tgaggcaggt ggatcacctg
34921     aggtcaggag ttcaagacca gactggccaa catggggaaa cccgtctcta ctaaaaatac
34981     aaaaaaaatt agctaggctt ggtggcgcat gcctgtaatc ccagctactc aggaggataa
35041     ggcaggagaa tcgcttgaac ccaggaggca gaggttgcag tgagccaaga tcacgccatt
35101     gcactccagc ctgggcacca ggagcgaaac tccatctcaa aaaaattaa ccagacggta
35161     gtggtgtgcg cctgtaatcc cagttactcg ggaggctgag gcaggagaat catttgaacc
35221     tgggaggtgg aagttgcagt gagcagaaat cacaccactg tactccagtc tgggtgatag
35281     agagaggctc catctcaaaa aaaataaaaa gaagtagttt ctgtaaagta cttagaacag
35341     tgcctagttc acaatatacg ctggaaaaaa aatgttacct attgctatta ctaaatgttg
35401     atacaacaga ccaggctggg tgtggtggtt tgtgcttgta atcccagcac tttgagagaa
35461     ctgcttgagc tcaagagttt gagaccagcc tgggcaacat agtgagacct cgtctctact
35521     aaaaataaaa agagttgcca ggcacagtgg cgtgcacttg tagttccagc tactcagcag
35581     gctgaggtgg gaggatagct tgagtccagg agatcgaggc tgcagtgagc tatgatgacg
35641     ccactgcact ccagccagag tgacagagca agactctgtc tcaaaataac aaacaggctg
35701     ggtgcaatgg ctcacgcctg taatcccagc actttgggag gctgaggcgg gtggatcacc
35761     tgaggtcagg agttcgagac cagcctgggc aacatggtca acccgtgtct ctactaaaaa
35821     tacaaaaatt agctggttgc agtggcacgt gcctgtaatc ccagctactt gggaggctga
35881     gacaggagaa tcacttgagc ccgagaggcg gaggttgcag tgagccaaga ctgtgcaatt
35941     gcactccagc ctgggcgaca gagtgagact ccatctcaaa ataaataaat aaataaataa
36001     ataaataaaa taaaaataat atacaataca aaaaacagac cagataacct gaagcccttc
36061     ctactaaaata tgcctagaag tgctcagaaa aatataataa acatccttct agactgtgcc
36121     agctattaag gtattgtctc tcagctccaa atctaccctg ttatgctccg ctttgtgatg
36181     ctggggcctg gactccacta aaccccattt cacatttgcc agctggatcc ctgtcaacag
36241     gggtgctaa ggggaaaaca gaagacaaga gaaggctaca agggacttcc tccttcttgt
36301     agcctggtgt ttcttgacaa cagaagttgg ttcttcccag ttgcYttcta aactcccaaa
36361     accagcctcc tgcccctcaa aggcaccagc atcagctaag taaggctcaa cagaagccag
36421     ctcctccagg ttcctcctat aagggcctga gaaccagca gcaccaggta caccctctc
36481     cagagaatct gggtacagct attccagatc cctctagact tctaggttct ggtagcccca
36541     accttcctcc ctttgttttt cagtcctgga tgagaaaaat tctttatgca gttattatat
36601     tgaagttact ttaatattcc ctttctgctt tttcagccct ccaccaaggg tttaaatcaa
36661     tctcctttat ggagttcact ctattgtgtg gtttctgttt tgctgattgg atctgaactg
36721     acatatagat aaactgagct ctcaagaaag taagaaaaat ccccaggaac cagaaacaaa
36781     ttagtgagga ggattagcga gctgatgaca tagctgtcct agccgtgtat ggaatttgta
36841     acaccctcat aggttcagaa gacagatctt gagtccacaa aaggcactga gatccctgtg
36901     cagaggctga gattcttaag tttatactca gtaagataat agactaggaa aaaaaatctg
36961     tccagagaga aataaaaaac ttgccttgct cacctagtga gaaaggaggg aaaaaccgtc
```

FIGURE 4-K

```
37021    taggaattca aaacaggctg ggtgaagtgg ctcacgccag taatcccagc acattgggag
37081    gctgaggtgg gtggattgct tgagcccagg agttcgagac cagcccgggc aacatggcaa
37141    aaccctgtct ctacagaaaa tataaaaatt tgccgggtat ggtggtgtgc acctgtagtc
37201    ccagctactt gggaggctga ggtgggcgga ctgcttgagc ccaggaggca gaggttgcag
37261    tgagccaaga tcctgcaact gcactccaac ctgggcaaca aagccagaca gatcctatct
37321    caaaaaataa aataaaataa aataaaattc taggaagcag acattaatat gtagtgaaaa
37381    acaaacaaac gatcagtggt tcctggtatc agggtgaaag gaaaaacgga ctgtaaagaa
37441    gtatgagagc cgggcacggt ggctcacgcc tgtaatccca gcactttggg aggccgagga
37501    gggcagatta cctgaggttg gcagttcaag atcagcctga ccaacatggt gaaaccccat
37561    ttctattaaa aatacaaaat tagctgggca tggtggtgca tgcctgtaat cccagctact
37621    caggaggctg aggcaggaga atcgcttgaa cccaggaggc agaggttgca gggagccgag
37681    attgcaccac tggactccag cctggagaat aagagtaaaa tccatcttaa aaaaaaaaaa
37741    gcatgagaaa tcttttgggg gtgagagaaa tcctctgtat cttgattatg gctgctgttt
37801    acaggtgtag acatctgcca aaactcaact ttcttgaaaa ttattacaga cacaaaattg
37861    aaaacatgag acaaaaacaa gatcacgaaa aacaagcaga tttgaaaatg aaccaaagag
37921    cacttctaat aaatgaaaaa gttagctaat aaaaataaga attcaaaaaa caaattagac
37981    ctagctgaag agtaaactag tatactagaa gatagatata aggaaattat ccagaagtta
38041    acacagaaag atagaaatgg aaattatgaa agaaagaata agatgtagac gacagaatga
38101    ggaagttcaa cataMgttac gcatgagatc tgagagaggt aaagaggtaa tgattgggaa
38161    ttttttacaca attagtgaaa agatatgaaa tttcagatta aggaattact atatgccccc
38221    agtatatagt gatttaagaa aattaaattc acaccatgta atggaagtac agaacacaaa
38281    tgacagcaaa gaagatctta aaaacaaaca gaaagaaaga caggttaccc acaataaaat
38341    aagttaattt gcaagcatag ttctcaagag taacaacaaa aagccagaat ttcaatgaaa
38401    aaacactttc aaagtgctaa gagacaataa ttggaagcct agtacccagc taaactacca
38461    atcaagactg aaagtgagct ggcacagtg gctcatgcct ataatcccag cactctgaga
38521    ggccgaggcg ggaggatcac aaggtcaggg gatcgagacc atcatggcta acacaatgaa
38581    accctgtctc tactaaaaat acaaaaaatt agccaggcgt ggttgcgggc gcctgtagtc
38641    ccagctactc gggaggctga ggcaggagaa tggtgtgaac ctgggaggcg gagcttgcag
38701    tgagccgaga ctgtgccact gcactccagc ctgggcaaca gagtgagact ccatctcaaa
38761    aaaaaaaaaa aaacaaaaaa ctgaaagtga aataaagatt ttttaaatga agacagtgtt
38821    taccactaac agattcccac tggacaaaca tctgaaggat gtatgtatct atgcaataaa
38881    aaaggaagga ataaaatgca aggaaaaata gtgaaaaagc aaacagtaga catacatggg
38941    taaaatgaaa taatcactaa caatacaaaa caataaacat attttaattg tgttggggtc
39001    tcactctgtt gcccaggcta gctaagaact cctgggctca agccattctc ccgcctgctc
39061    ctcctgcctc agcctccaga gtagttggga tgacagggca agccaccatg cccagctaca
39121    aaataataat tatcaattag aattgttcaR cttagagatg gattgacttt gggaatgatc
39181    tcattctaga aagtactcat tttgagtctg acaacacct tttggtatgt ttagtgtaca
39241    ctgggtaaga ggctaaatta aatgaccaca ccatatatta ggttaatgca aaagtaactg
39301    tggttttgc cattactttc aatggcaata actgcaatta cttttgcaca aacctaatat
39361    cttctgatca tagttttatc aattagacac agctgtccaa acagccctg atcagctctg
39421    ttcagccacc tgagcagggc tttgccctca tcctaaaagt tctagaattc aagtcttatt
39481    tcaaggcatt cttcccactt ccatgttcca catgtaaaaa agaattctac gtttcttaac
39541    gagctttcag gtaagatctt taagcttttg gaatgtaccg cttttcgctg tgaactaaga
39601    gcttagacat tacaattagt catcccttgc tagaacttag gctacgaaaa gaatactttg
39661    gaagctttca caaaaaagta tgtggttctt cctctaaaga agaaaatacc acacagaaag
39721    agggactgag gaaacataaa cccatctgtg ctgacagaaa gctaccttac atgatcctca
39781    tgttcgcccc aggttcccat atattcacag cagtaaagat ctccacaaag cagagaggcc
39841    caactccctt accattaaag ctttaacgac cagacaaccc agaagtttgg aaacatagaa
39901    ccaggcaaca gatactagag agagggaatt atgtattaaa gcaagaaaat atcatcacgt
39961    tttcaagagg gagtgccatt ccagtaaaga ggacagctta atactgaggt tcaaatgcca
40021    ctaaatgaaa acgggaaagc gaaattcctg tgcccttca gcccaagaaa ttattccaaa
40081    gcatacattt attcccatta catgtcgcaa atcctgccta gccattagga tacagtgacg
40141    aaaagtctc tcgttatcta gaagggcaga caaacacgca gactttaaa ataccagatg
40201    gcaggccggg cgtgatggct cacgcctgta atcccagcac ctttgggaag ccgaggcggg
40261    cggatcacga ggtcaagac tcaagaccgg cctggccaag atggtgaaac cctgtgtcta
40321    ctaaaaatac aaaagttagc cgggtggtgg agcgggcgcc tgtaatccca gctactcggg
40381    aggctgaggc agggaactgt tgaacccgg gtggcagagg ttgcagtgag ccgagatcgc
40441    gccactgcac tccggcctgg gcgatagggc gagactccgt ctcaaaaaaa aaaaaaaatg
40501    acaagtgcta actcagaggt aagcaaaaga gagtacccag aggcggcagc atcaacccag
40561    tgggctcccg cccacccaca atcttcacac agtcacacca cttatagtca taaatttgta
40621    ctctccgagg tgcgtgtatg aacatgtta tctgtgagag tccatggatg aaaaacaaaa
40681    acaaacaaaa attaaaaaaa aaaaaaaaaa agacttaacc tgttttgacc aggacaacca
```

FIGURE 4-L

```
40741   ccccaggaag taggtaaggc aggtaaggtc attgtttaca tatatgaaaa gtgaggctca
40801   aaatacactg accagtccaa gacaacgcgc gcccccacaM agcaccttcc ccgtccccat
40861   ttatgcccaa cccataaacc caaagtagag ccaacctcgc actggctacg taacccgggc
40921   caagctaaac attataaacc tcaggctccc catctttaaa gtataacagg tggttagaag
40981   attaaaaaga taaacatttg gcaggtcatt gtggacggtg tagctcagaa aatgctgact
41041   actgcactac cataactact gctattgtta acgataaaag gcaaagactt tccaggaccc
41101   gacccctcgc ttacaagcct tcgggaact tgccctatac ccccgacccc agtcaccttc
41161   agatttaatt ccacagacac gcccccaaac agaccctccc ctttaaggca ccccccccc
41221   cccggctcc tccctctcag gcgcctctcc tcacaaacct tacccccata gattctgccc
41281   tttcggactc ggttatggag gaggccttcc gctcgcagcg gcctctccag cacccctttt
41341   aggcctgagc accccgcaggg gtgcccaggc cgcacgccaa acgcgggccc gcgccggtta
41401   cctggctgcg cgctcccgct ctgcctcgcg attctccgga atcgtacctc ttcgtgggct
41461   cgcgccagcg ctgtgagcgc acaattagtt taaactatgg ccccgccccc tcgcgctgcc
41521   ctctgattgg cctctgtcgg cggggcccgc ttaaggaccc gggaaaagga agtttgaggg
41581   ccactgggaa agagaagggg tatcaccgct tccggacccc ggcctgtact tgaaggcaaa
41641   gagaactaca aatcccagcg tcaccgcgg ccttgaagcc ccgcccctga caaactgaag
41701   gtcccggtaa gcatcgcgtc agtacttatg gcgcctgccg ggttgtggtg acgaaagcag
41761   ttgccatgga gttgctctga gtaaccctga ggcagtggga cgccaagact ggagaggaag
41821   cgactgcggg tgagtcgggc gggaaaacag gaaacccgtt ctaggggaca agagatctat
41881   ggagaaggga gggcactca cagaacgact aagaaccttc ctgctcgggg atctgagatt
41941   tcccccaccg accctcatca cctttcacRg cgaacaagat acaacactca catggacag
42001   actgggcgag ggggagcaga gggagggata ggcgttgaga tataYatcca tacagatttg
42061   gggatgctta agaaccaccc ccagggccgg gagcggtggc tcacgcctgt aatcccaaca
42121   ctgggagacc aaggcgggcg gaccacttaa ggccaggagt tcgagaccag cctgagaaac
42181   atggcgaacc ctgtctctac caaaaacata aaaaattag ccgggcttgg tggcgcgctc
42241   cagtggcccc agctactagg gaggctgagg tagaaggatc gcttgagccc ggagattgaa
42301   gctgcagtga gccgtgatca cgcaactaca ctccagcctg ggctatagag cgatacctcc
42361   atctcaaaac aaaacaaaac gaaacaaaac aaaaacaaaa caaaacaacg aaccccgccc
42421   ccaacgcaaa cataaagctc ccaaaatcgg atgcttcaag ttccaggcat aacctgggag
42481   atcagaaacg ccctcagaaa tggggttggt tttcctctga ggaactgaga ccctcttcca
42541   agacatgcgg ttagcattag attgagtaaa tcgcagtcgc taccctaatt ctagagatgt
42601   aggaaacttc ctggggcgtg aagtgcctca ttccttcttc ttccaaggag taaaaccccct
42661   tctcaatctg tccccagatt ccctttttctc cccacacctt ctccgtggtc cgctactcaa
42721   agctctcaca ttagagcttc attttttta gtactcacga cagatctatt acatttagta
42781   acctacccag tgctttcaca gtctctcttt tgatactctt aacagctctg tgagtcaagg
42841   atatttatct tcatttcaca gattggaaaa ctgaaaccca gagaaagggg acttgcccaa
42901   ggccacacac caaattagtg acagagctag aactagactc cagttctccg acttccagct
42961   aagtctcttt agcttcagcc tactgcctct atagcggaag gacttgttcc aaggaacaag
43021   ttaaactgcc ccagggaaaa ggaacctgtg tggcctactt tgtattattt acacttcagc
43081   tggaatgaat tcagatcct ccctgaaac ttttaatggg gaaaaggaac tagagagact
43141   aagacaatga gacttgaaca ttttttaacta acaggaaac agaagggcta cacacagcacc
43201   catgtctgaa gtgaccatga ttagctggtt tctagctggt gactagctgg ccctgactgg
43261   tccacttact accttaaagt tctcccaggt ttggtcctac gccctcttgc cactgcactc
43321   tatattctct tcttgggtac ccctccacac ccacaacttc attttccacc tgtatgcaaa
43381   tgtacacaag tgtgtatctc aagcccagcc ctcatctcta agctccagat ctatatagcc
43441   aattgcctca acatctcctt taggatacct caaaggcaac ccaaactcta catttctgaa
43501   attgaaacaa tctctgtgta tccaaccttt tcctccaag cctggatctc ttccagtgct
43561   cctaccttta tccacaatat acccaagccc aaaaccaagg ttagtacctc ttccattac
43621   ttaatacctc ttccatttcc catctatcac taagtcttat cagcttact tcctgaatat
43681   cttttatata ggtcctagct accatcacat cctttcctgcc ttccctccca gccatatttg
43741   cgcactgcaa ccagagtgat ccttcaaaat gcaaagctga tactRttcac tctctacccc
43801   accccaatt ttttttttt cttttgaga cagagtttcg ctcttgctgc ccaggctgga
43861   gtgcaatggc gcaatctcgg ctcacagcaa cctccacctc ccggtttcaa gcaattctcc
43921   tgtctcagcc tcccaggtaa ctgggattac aggcatgcgc caccacccc ggctaatttt
43981   atattttag tagagacggg gtttctccat gttggtcagg ctggtctcga actcccgacc
44041   tcaggtgatc tgcccacctt ggcctcccaa agtgctgaga ttacaggcgt gagccgccac
44101   gcccagccag ccccatttta atattaatac tatgtggttt cctattgctc ccatctctcc
44161   agcctccagt ctaaccatac atattcatcc ttctctcccc ttcagttata taaccttaa
44221   ggtcttcaaa atttccaagt acccttccac catgaaacct ttgcatatag cagtcacatc
44281   tgcctggaat gctcattcca caccaccccc tacccataa gttaatttgt acttatcctt
44341   tagatttctc tcagtcactt cttcaggaat gtcttcctgt agactgttca gaccaggtca
44401   gatccctcaa ttacagcaac ctcatggccc tctcctttgt agtRttattt agttgcaatt
```

FIGURE 4-M

```
44461    tttaatgtgt ttgttaagca cctactactt gccggcacta tgagatacaa ctgtaagaaa
44521    aaatatggtt tctgccctgc tggtgtttat ggacatacag atagtaagca gataattaYa
44581    gtgttacgag tgctaccatg gcaatcatag cactacaatt acagatttga ggataaaggt
44641    agacttctca gaaaagttga aacctgatct gagccctgaa ataagaatta gcaaagcaaa
44701    aggaggagag aaaaactata ttccaagcag acagagctgg aaggagacac tgttccactt
44761    agaggcccag tggcaggtgc agggaactta tggtgagtgg ttgcatttgg ctagactgca
44821    gaattggagt tgaggatgag atggtagtag aggggggtgg acaggagcca ggttgaatct
44881    tggtcctcct tttggcacct gggaatataa cctcccagaa tatattagat tatgtggcag
44941    attttttcttc ttttttcttt gacagggtct cgctctgttg cccagactgg agtgcagtgg
45001    cacagtcata gctcactgca gcctcgaact cctgggcttg agccatactc ctacctcagc
45061    ttcccaagta gctgggacta taggcgtgag ctgccatgcc tggctaaata tgtggcagat
45121    ttttcatagc agcctttgat tttttttcca ccatcagtcc atcatcagaa actctcgggc
45181    caggctgttg aatctcctat cagatttatg tgattattcc tcaaagcttc ctgtgttatc
45241    atgttgcaac ttgcctgaga gagggcagga ataggctagc aacaaatcaa attccaaatg
45301    ttagtaattt cccaaaactg aaaacagttt tctgtcaact tgggattggt taaataaatt
45361    aagtgaataa cattaaagta cgataYatag tataaaatac tttgcaacta ttaaaaaggg
45421    taatagtcta caacaatttg aaaattaaaa aataggttta caaaggaata ttgtttattt
45481    aaaaatatac ataatctagg ctgggcacag tggcttacac ctgtaatccc agcactttgg
45541    gaggccaagg tgagtgaata gcttgagccc aggagtttga gaccagccta agcaacatgg
45601    caaaactgtg tctctacaaa aaatacaaaa attagcaggg tgtggtgacg tgtgcctgta
45661    gtcccagcta ctcaggaagc taaggtggtg ggattgcctc agcccaggag gcagaggttg
45721    cagtgagctg aggtagcacc attgcactcc agcctgcaca acagagcgag accttgtctc
45781    aaaaaaaaaa aaaaaaaaga aaccgtgtg tgtgtgtgtg tgtgtgtgtg tgtgtgtgtg
45841    tgtgtgtgta aaaccttatt agctatacat tctaggttat attcccaaac tgttaatgga
45901    gattcaaact ttgagtttct atttgatgta cttcttgtca tttcacttta ttcatctatc
45961    atattagctt ttacagttaa aaaacaaaac agttaaagat actgtcaatt tggaaatgag
46021    aaattccagt tccgaaacaa ggcaggtatg cccctaaccc tgtcattcat caagttagtc
46081    agtctggaca gatgaaggtg ctggcatctg attacctcct ggtcataagc cagaatagca
46141    gatgggaaag actgactcca aaaacacagc cacaggagta agcatggcag catcaacact
46201    ttgtcagttc tccccagcag tcaagctctc tatgtgacac cttgaagact ccattaattc
46261    cttcatttct tctttcattt ttccattgtc catccatttt catttgtcca tcaaaccttt
46321    agtgaatatg gatttttttt ttttttttgg ccaggctcaa tgcagggtaa tgatgagaag
46381    ggagaaagaa gtctgagtct tgtccctgtc tcaagctta tagggagtaa acaaagttgg
46441    ttataatgaa attaacagag aatcaactg cttccattta ttgagcacct gatgccagat
46501    gtacaatagt tctcaaggta gggtttgtct ccatttcaca gatgagtaaa caagctgtaa
46561    taaaattttg tttgaagtac agtgggggca tgcagaagtt agctattgcc gtgtaataaa
46621    ccatcccaaa acacagtggc ttaagataat aaacatttat tattgcttct aagtcttaga
46681    gtcagctgga gggttcttct gctttggctg ggcttactca tgtgtcggca gtcatctgtg
46741    ggttgggtga ctctcctgat cttgactggg ggtaggctga ctgtgggcta gtctaggatg
46801    gcttcagctg gtatctctgg ctctttYgca tgtctctcac ctacacatct cataaccctc
46861    cagctgatca gccatgttct catggcactg gcaaagagca gagggcagg cctcctttaa
46921    agcttctgtt tgcttcatgt ttatcgacat ctcattggct aaaacaagtc acatgtctgg
46981    tcccagcatc agagtgagat gggactacaa tgttataggc aaaagagat ggatacaggg
47041    gagaccatga atagggatca tcaaaacaat cagcctaaca caggacacat taaccaattt
47101    tatctggaaa agaaaggctt tatagaagag gctacactag aactgagtgt tgaaacatga
47161    gagagtattc actaagtggg cagctgttac ttggaactgg atgcaggctg gtttaccaca
47221    atcaataaga actcagcagg tctttctgtg ctcatgacag ggttctatta tttgtatctt
47281    ggcttcattt cttctggtca ggcacagagc agcaagcacW caacaaatgt ttgctgaatt
47341    gaattgaata tcttactgtg aacaaggtgt ggactgaaac agctgaacct gggaaccaat
47401    tgttagaaag aacagcttag catcaactct tctgaaacag aaatcctcag aattggcagt
47461    ttctcattca ttcatcccac aaacattttg agtgcctgtt gtaaacctgg ttctatgttg
47521    gataatgaat aagatgcgat actagctcac agcctgggct acagcttaaa tgcagaaggc
47581    taaaaattta accagcttct tggggctcca ttttttaatac taatYcattc agaaaatgca
47641    acaggagctg gtgctacaca aaatcagaag tctttaggaa ctgcactggg ttgctctgtc
47701    aagaaaacta acagtaaaaa tctgcccta agtattttaa gttaaaatcc atgttcagtg
47761    gtgcataact ctggggtacc aacccagtat ttactttgag aaaagtatcc aatcttgctc
47821    aaaggtatca aatctgYtgt aggtgctgaa gtgggatgag cttctRtcta agctaggttc
47881    ctctagttct gtagtagaca gccaggttcc tctatttta caaaagaata atgtgttctt
47941    tgttgtctgc ctgtagattt aatatctaaa agattcaagt ctccctaatt gacaatccat
48001    gcccatggga ccagttcata acagaattaa gctgtgaagt gactcaatct gtcacctccc
48061    caaagctcag ctggtactgc tatttttca gaacaagaca ttcattttcc tctaaaccta
48121    ctaaacttga tccatgtata tgttaaattg ccaaaaaagg aatttacatg aactgtatta
```

FIGURE 4-N

```
48181   ggcttaaact gaattataag atatcaggtc cttggttttt aacagaaatt cttttttttt
48241   tttttttttt tttttttttc ctgagacagg gtctacaggg tcttgctctg tcgcccaggc
48301   tggagtgcag tggcacaatt atagctcact gcaacctcca acttctaggc tcaagcaatc
48361   caactgcctc agcctcccga gtaataaatt ccattttaaa gttgtttgcc aatttcattg
48421   tctctgcaaa ctaatttatc ctttgaatcc aatgatgaga actgcaatcc caaggtttct
48481   cttttttgctt tggctgccag gaatttcaga gctaaatgta ggcttagatt cttaaagtgc
48541   ctggcacatc tctctcttcc tgtaatctag tttctgatct ttctcttcca ttttttaactt
48601   tctaatctgc actgtccagt atggtagcca ctagtcacgt acatttgaca ggtaggctag
48661   tccaaattgg gatgtgctgt aagtgtaaaa tatctcagta agttttaata ttgattacat
48721   attgaatgat ttttttgatat attgggtaaa attaagttat taaaattaat ttcaccactt
48781   catttttactt attttggcta ctagaaaatt ttaaattata tatatggctt gcatttgtga
48841   cattatattt ctagtggatg gcactattct gcaaatcatc tgttttatga ctgtgttatt
48901   attgtaaacc tgaaatcctt ttggaaagca ggtgaagtaa tacaaataat aatacaaagg
48961   tggcagcagt ggatggaatg agaaagggga ggtcgactgg gRcaagttct tgtccttatc
49021   cttgtcaatt tgtcttttgc ttgtgtgatt cacatacaaa ccccttggta aagtgtgttg
49081   tcagctctct tcatcccagg tgagtagtat tctcatggct ctcccttgtc tccagaaaaa
49141   cctcagcttt actttagcta acaaattgga aacgatctga taagacaatt cacaccacat
49201   tgcaagtgac tgataacaac attgtgttca tccctgtcag ggagtatttc cattttaacc
49261   ggaaacaatc cctgaaccca caggaatgaa tgcctaatgg tggagtttca gccatcagtg
49321   acaggtgagt gagaggtaga ctctggtttt gtgtgtgtgt atgtttatat gtgtatggct
49381   acattcagga tagggctgaa agtagggtat ttggatggaa aggtaatggg ggtggcagag
49441   aagccaagcg gagaaggtgg caaatccccca gctgggccag actgagaggg gtggtgagac
49501   accaaccaga tgcggtgcag gccctcaagg atttgttaag caatagaata gcccagttga
49561   tgtcaMcaga gggtgggtat caagacagtc tccacagtaa ctactgtaga gtaacagaaa
49621   aggtctcaga gtaggattca ggagattatg actgcagtct acaactgact cactggctta
49681   actctgggca agtccttttta ccccttgggt ttcagtttct tcatctggca ttttccagac
49741   aaagaaatgg gtgttcgatt ctcaaatgag ttctaagaga tgtgaaggtg ctctgagaag
49801   tagaaagtgc tctatacatg caaggatgca aggaagagtg atttcatatc ttaaaatgga
49861   aatacagcca ggcaggccta gagtagtaga ggacagaaag cagggatgga ggactatggg
49921   gaaacctgaa agccggtgta cttgaaacac tggtctttct ctgtcctccc aggctgaacc
49981   cagactccca gggcacctgc ttgcacctttt gaatgatggc ctgaactatg aacaaacggg
50041   actatatgaa cacttcggta caggagcccc ctcttgacta ctccttcaga agcatccacg
50101   tcattcaagg tcagcccccca gagcacagta ctccactcac taaggcagca ggcccagtgt
50161   ggtccctagg aagaaaccat aatctactta aaagcctaaa gagattcttc ccatatgctt
50221   gcagatgtgt tgttactgtc ttttggaggg tagggggagag tgagaggttt ttttctgtct
50281   ttttgtttgt tttgatttttg ccccgataca gccccaggag atcctaagaa catgtgcccc
50341   tgtttgttttt ttttaagcag caaatctgaa aggaaacagg gggctatcac agtagttgat
50401   catctttaaa agaagccagg ctacagcagg aaagtcaagt ggaagaaaac tgggaagcca
50461   gtctatcagc caatagttttt attctcctgt ttttacctga agagaggagg aaaacacagg
50521   ctcctgtgga gtcccagcaa gtaggcaaaa cctttctcct ctgtctgcag acacaagcct
50581   aatctgactg gccaaacatg agggggtctta tctacaaact ggcatatttc cagtttaaat
50641   acttactgac aaatttctta cactcattcc agccaaatcc aagtttattc catcatcacc
50701   tacacttatt gcaggttcca acactgtcca cactcgctcc cattttgcca ttcaatgtct
50761   ttgtaaatgg gtagctagtc ccttcaggag ggaacatagg gaggctgtca gccatgtcat
50821   attcccaatg agtcatccgt tcttcctagg gaagttctgc catccctggc ttttgttatc
50881   tggtctttca ttaaagcatc agtccatctg tcctcacaga atacacgtta acatccacta
50941   tctcagaact attatttggc tttagtcttc tcaggcaa ctggtagcca ctgcctttaa
51001   gctcgggaag ctggcaaata gcaccagtct tagattgggt ttagggtcta cttgggttat
51061   catcagccac agtggtaact cacgtttgtt ctctcacgag cacacagcca cctgctgtga
51121   tcttttattgt gcactgcatc acttctgatg taatccatgt ttcacaaggg gttttagctg
51181   caatagtaac tatctctaag acaggtgcaa tgacagaggt gggaaggaag tatacctcct
51241   acctatcatg ggaatttcta actctgatgg aggaggtgta gctctgccct ctatggagtc
51301   ctcagaattg ggagagagac aagcagtacc aagggtaact ctacatcaca aaacgtaaat
51361   ggtacagatg gcccatcctt cattcaaccg ttcaatattt actgagcact tactaaaagc
51421   atttatatat gtgtgtgtgt gtgtgcgtca tatgtatatg ccaggtattg tgctccttgc
51481   taggtatgtg aggcacatca aaggcccaaa aggtcagagt cccttcagat tccccagagc
51541   ttctgaaaca cttatttaca gctggggtta agggatacaa tagagtttgg gggtacctgg
51601   cacactattt ggtgaatgaa taaatattac agaatctgaa acggcagtgc ctttggaagg
51661   catctaatct gtgctaccat caacccagtt cctctaactt ttcacaaacc tagagtgtta
51721   aggaagtccc ccaccatata cacctaccaa caccttccag ttggtggttg agggatgaca
51781   cagggaagtt caatcaaact aacttgtatt ctgacacatg gcaagagcta catggcagcc
51841   tttcagagag aggaaaacag gaacatagtt tcccagatct tcctggagct aaatgctccc
```

FIGURE 4-O

```
51901    cagttcccaa agcattgata tttgtggtcc agcttccaga cctgctttgg cctactctga
51961    acaaggaact ttacagattc ttaggcagtg tagtgcattg gtggaatctg agaggagcag
52021    caacctgtgg cagcctggat ataccactcc atccttgRta agagcagctc cagccagcat
52081    caagttttag gcaactctgt cccaccagtg attccctctg agcttggcct ccaccccatg
52141    cttggtggca ttccccaagc tgctacctta tcacatgggg cactagttca tgtggggtta
52201    ttttgacctt aattttgatt catctgtgtc attctgtttc agggttctMa ggaggtRtgg
52261    ggagggaagc aggattagga attcatgagc tggggtacgc cgttccagta ccctcctgca
52321    accccaggcc ccaattgtgg gtcctgctca ctctaggatt aaggcagaga gccatctggt
52381    ggatgttgcc tgacctgcat ctgaggagga ggagaggtgg gggtggaagg gcaaagggtg
52441    tccttccagt agagagcaga agagagtgaa gaaagctggc tagcttccgc aaatactaaa
52501    tacttccttc cccaggggtg aactagggaa ccaaaggctt agcagcaatg ggaactggac
52561    ctcattttga aaaagtggga gtgaggcttt ggggtgttcc atacaccggg gttctaacat
52621    aatcctattc cctattctct ctcctcctca gccaaacttt ctgaggatgt tgtttatgct
52681    aactgcttat atccattcac tctttttttg gtagagacgg ggtttcatga tgttgcccag
52741    gctggtctca aacgcctagg ctcaagcaat cctcctgtct tggcctccca aagtgctggg
52801    attacaggca tgaaaccagc ctccattcac tcttgaactc actcacttcM atctggcttc
52861    tgcctccagg cccttgccat tccactgaag cagcccttac caaggttacc agggacttct
52921    aagttgccaa aattacttt cagtccttac ctccctggaa cttactacta taaactattt
52981    actccctgaa catctttaaa ctgtcctctc ctgattttcc ctgatcattt aacttctcta
53041    atggattctt cttcctccct gaccttcctc cctaccctca ctctccctga ggaatctcat
53101    ctcttcccct aacttgtatg ccttctatgc taatgattct caagtctgtg tctcctgagc
53161    ttccgacctt catctccaac tgcctacttg acttctccac cttttgtac aggaacctca
53221    aatacaccaa agctaagcct gaactcatca cattcccaat gctatttctt cttctgtaat
53281    tccttaccag ttaatacaac tggcaaccac cctttaatat tcttctacct ttacatccag
53341    tcaaccaaat tatgttgatt gtagggccct ctcatgtctt gcttggatga ctcaaacagc
53401    caaattggtc atttggtcca actcactccc taaaatccat attccacact gacacttaag
53461    agtgatcttt ctgaaataaa agatttgaat catttgcttt aaacactcca gtgccttccc
53521    attacacaca gggtaaagcc caagatcctt agcctgacat ttgagacttt tgactggatt
53581    cctgcctcct ttcctctct gtcccccttg tgcagtgcgt gcaagcactt gtgcaggcac
53641    acaaacccgc cccagactcc ctggctgttc tgtacctcta taccttcctt catgctgttc
53701    cctgcctgtt taccccttctt tgcctgataa acatcccta atccatggag attcagctca
53761    ggcttcacct tccctgggaa acttccctga gctcccatac tgggtcaata gcctctcttc
53821    tgtgctgcta caactattat atagcactta tcacaccatR ttgccagctt gctcccatct
53881    tgcccatata agctcctcca aggcacaaat gtctgctctc tgccctatta ttcatacaaa
53941    gtctggaaca gactgtctct cattttgttt atcactgtat atccagtacc tggcatactg
54001    taggtactca acattcatgg aaagagagac aggatatcaa agtgtattcc aYtgaagtga
54061    attctatagg ctttaccagt agttaattca ggatttgtg ctatcatcta ctcagctcaa
54121    gcccaacaat tctggttctt agttttcctc aaccccacac tggtttggta taaaaaagac
54181    ccagtggtac agtggacatg agaagtccat gtgacctgga aagccaagag cttgagatag
54241    aagtctctgg cccttagtct aaacttactg attgctggaa gctgtgggac agggttgcac
54301    tagactcagg cacagggcta tggcccttcc agaccctcca gctacagcct ggatggctaa
54361    tcttccagc tctgtccctt cccaccccct aaagccaaaa aagcaaagat Ratacccaag
54421    tctcactttg tccccacaga tctggtaaat gaggagccaa ggacaggact acgaccactg
54481    aagcgttcaa agtcggggaa atcactgacc cagtccctgt ggctgaataa caatgttctc
54541    aatgatctga gagacttcaa ccaggtggct tcacagctgt tggagcaccc agagaacctg
54601    gcctggatcg acctgtcctt taatgacctg acttccattg accctgtgag ttcctaacag
54661    taggaatcca gtcaggggag cctgaagcca ctttgttcag cccccaacct ctccactcct
54721    acatgttatc aaggaagtaa tgaggcagca tggtacagtc caaagcacaa ggctaggggg
54781    ccagacagat agatgtaggt tcaaatcctg ggtttgcctc ttactgactg tgactttgag
54841    caagctacct aacctctcaa aactgcagcc tccctgtcgg aaaaatgggg ataatatgcc
54901    agtatcataa aggttttgtg aggattgaat gaaaatacat gaaaccacc gggcacagcg
54961    gctcacgcct gtaatcccag cactttggga ggccgaggtg ggtggatcac aaggtcaaga
55021    gagatcaaga ccatcctggc caacatggtg aaaccccgcc tctactaaaa atacaaaaaa
55081    ttagctgggc gtggtggYgg gcgcctgtag tcccagctac tcgggaggct gaggcaggag
55141    aatcacttga acccaggagg cagaggttgc agtgagccga gattgcgcca ctgtactcca
55201    gcctggcaac agagtgagac tccgtctcaa aaaaaaaaaa aagaaaaga aaatacatga
55261    aaaccaacaa acaactggta catcagaggc tgaagtaaaa ttStaactgt cactgcgcac
55321    ccactgtgac ctgtgctggg ttctcctgtg gaagaggtag tcaataaagt acagcactta
55381    ctttctgtga actcagattc aagttttaag aaataaagtt tggccttttc tagtccaaga
55441    tccctaagag gggaaaggag ctggagcatg acttggacac tattccctg gtgtggtgat
55501    ctcaatttaa ccagtatttt aaaagcttct tatgtgccta gcatgatgct ctgtcttcct
55561    gttgcttgct gtgatagaat cgtagatcac caaagctgga aagtcttca gtgaaggggc
```

FIGURE 4-P

```
55621    aactaaggct gagagaggca agtcagtggc agtgctggta cccaggccca cactcctgac
55681    cctcagatca cagctccttt tcagtgtgat gccctgtatg tcttaaaaca taaataaaag
55741    taggttacag tcatacagta tggctgtgga gggttggagt ggagggcagg ttgttcccca
55801    cattcttcct tctctgccca cgagtcagcc ctgagcagag attcagggtc ctgtcctgtc
55861    tagcctggct tttggtttcc ctccccaaca ggtcctaaca actttcttca acctgagtgt
55921    cctctatctt cacggcaaca gcatccagcg cctgggggag gtgaataagc tggctgtcct
55981    tcctcggctc cgtagcctga cactccatgg gaaccccatg gaggaagaga aagggtatag
56041    gtaagtgccc tgcccctgga ggtagcgtct agctgggctc ccctaaagga aaggaggagg
56101    agaaacaaga aatctacgac cattcttctg ccatgcttgg acctgggaag ggagtaacag
56161    acctctaagc attccttgct ctcagtcagg ataaacctaa tctttcccaa actatgctca
56221    agtccctcca ttccttgcag tcagggaaga caacagcaac tagtggaggg ggaaggggat
56281    tctggtgggg gtgctggccc ccagcctaag tcttccccac aggcaatatg tgctgtgcac
56341    cctgtcccgt atcaccacgt tcgacttcag tggggtcacc aaagcagacc gcaccacagc
56401    tgaagtctgg aaacgcatga acatcaagcc caagaaggcc tggaccaagc agaatacact
56461    ttgaggctcc cacgacccta gtagtcctaa aggcctaagc atagacagca tggtttgaca
56521    ataaataatt tgagctgttg agcagatgag aagtcactta caccttgtag agatgttctc
56581    taactcaggc aactgcaagt agctctagcc ttttcttttc ttttttttt ttttgagacg
56641    gagtctcact ctgtcacaca ggctggagtg cagtggcacg atcttggctc actgcaacct
56701    cagcctccca ggttcaagag attcctgc ctcagcctcc ccagtagctg tgattaaagg
56761    cgcctgccac catgactggc taattttgtt gttgttgttg ttgttttgag acggtttcac
56821    tcgtcacccc agctggagtg cagtggtgcg atctcagctc actgcaacct ccgcctgctg
56881    ggttcaagcg attctcctgc ctcagcctcc tgagtagctg ggattacagg cgcctgctac
56941    cacatccagc taattttttt ttttgagacg gagtctcgct ctgtcaccca ggctggagtg
57001    cagtggcacg atctcggctc actgcaaact ccgccttcca ggttcacgcc attctcctgc
57061    ctcagcctcc caagtagctg ggactatagg cacctactac cacgcctggc taattttttg
57121    tattttagt agagacgggg tttcaccatg ttagccagga tggtctccat ctcctgacct
57181    tgtgatccac ccacctcggc ttcccccagc taattttta tattttagta gagacaaggt
57241    ttcgccatgt tggccaggct ggtcttgaac tcctgacctc aggtgatccg tctgctttgg
57301    cctcccaaag tgctggatt agaagcgtga gccaccacgc ccagcctttt tttgtatttt
57361    tagtagagat ggggtttcgc catgttggcc aggctggtct caaactcctg acctcaggtg
57421    atctgcccac ctcagcctcc caaagtgcta ggattacagg ataagccact gcacctggcc
57481    agctctagtc ttattttgct gaaaaaggga ggcaattgag ggaaaggcct gctggcctgg
57541    gacactggag acgtgggttt accacacagc cttgggaaat ttatctaact tctctgggcc
57601    ctttgtactt ttcagcttag agatttgggg gttaaagtag atcagtaatt tccaaactct
57661    tcacagagta ccagggtctg tagagatgcc tcacaggcct ccatgacagg ccaagaagat
57721    ggcctatgat ctctgaaacc agcccccact tcaatcagat caaagtaatt ccattctgtt
57781    ttatatgctg ggattctgct taagatttca tttgataaaa agaatcttct gcttaaaaac
57841    atttgcttgc tgactccata ttaggtattc ccagaagagc ctggtctgct ttctctctcc
57901    acccccaac ccgccatgtc tcccttcacc cccaggggct gttggtaatt ccattgagtc
57961    tgaggcaggg cccccaagaa tcaaagctgc ctcagattca ggtctgttca gctttgacag
58021    tgttcccatc atcactggac aagggacaag aacagtctca tccagtctga ggttagccca
58081    agccaggtct cagctaagag ctgacaccct aaacccttgt ctcttgggtt catcttcaat
58141    atccctggaa gatgtcccct tcccccatc ttactctcat agacctaagt aatcaaaagt
58201    agaatgggta gaacagaggg gccagaacca gcacatggat gaatatactt cctttatcga
58261    gggtgacaaa ccaaaacaaa aaagaccaa acatgtaaaa acccagggtt ctagaaatac
58321    aaactcaatt cattcaaatt caagctcatc cagaccctgg tcacaaaccc tagtgaggtg
58381    catgtgagca ccaagtcagg gagagggggc aggagtgact ctgaggccaa cagagagggt
58441    gggaagggga tctccctagg tcccctggtg atcacccccc acccaaactg gtatctccac
58501    attctcaatg actatgagaa cataccaggc tctgtccttt tggcccccac cccatccctg
58561    gccagagctt caaaggccag tcccaaaagg ttctaccctc acttgctcag gcttctagcc
58621    ttcctcttct cctccttctt cacatttttc tctgtgatta gtagcaggtt agggtactgt
58681    ataagccgca gtgaggctgg gggccaaggg ggtggggtag agatgggatg aagagaggag
58741    aagagctgtc caaggacccc tctcttcatg ggatcccaaa ctgtacaacc agctcctctt
58801    ttgcgtccac acggatctga gaaagtgcac tgtaggcata agcagctatc ctggagacct
58861    gagacagaga ggggccgggg aggagaggaa cagagacagg tgaggagggc aatcaggaaa
58921    aatggggagg ggagattaga tggtgatgga gaaggaggga atgaagggga acaggaaggc
58981    aaagagaaag acagggatgg gagagacaga aggaaaagaa caaagggag tgaaacaata
59041    aaggttgcag gaaggagata ggaaagacat aaaaagttaa gagaacgagg tgggagggag
59101    ctggggccta caaggctacc aggctcccta actccacctt ccctacctcc tctgaggcag
59161    agtgggtgaa ccctctgcca taccctgggc agtgtgagaa gggtgggcag gggcaggtga
59221    ggggtgtctc acctgctgca aatcagagaa cgggatgggc tcactggcca gcacttggtg
59281    gggctggctg gtaagagacg gcagcggtgg cagcttcttc caatgggtca ggctgctgct
```

FIGURE 4-Q

```
59341    cagcacagcc aagcgggtgc tgaccaagag agaggggtg ggggtaggca gttaagcYac
59401    agtctgccct gcccagccca ggtaagcctc atccctcag gccagagaag cagggtgtcg
59461    aggaggggta tctgggaggg aaggtctcag ctcatcacag actcaatcta ggcccatctc
59521    ccttggcctc agYgccctca agagtgtcac agggtaaaca gggctgacat gaataactac
59581    tgaagcaccc aagtgatctg tggtcagtct ccagggctgc accaaatgag aagcttggac
59641    taggggccag gctccaaagc tggaacagtg atggagggtg ggagcccaag tagcctgagg
59701    gacccacgct ggccaggtgc tcacctgtac tgcctggcac ggtccatgta ctcatgctgc
59761    tccatgccct gtgagtctgc agcagacaca tcaatgatgt tgctatgggg agaggagaca
59821    gagatgacat gacaggtgct tccgagaagg acaaacagga ctcagtgcca ggtaccaact
59881    ccagggctat ctgacaccag tttccctcct gcctactgga gcagggctgg acatggaggc
59941    acctctcccc agtgaccttg tcccatcccc catgtcctga gcctggctcc ttctatccta
60001    gcctttaata tggatagagg agctctgacc caggcctggt cctctgacac ttacctggct
60061    gtcttggcaa ggatggaaga gagcagggcc tgctcatcag tgcgagcgga aggcaggctg
60121    tggtagttgg gctcggctcc attgagagct ttggtagggg ggctgctagg gtccagcagc
60181    agcttccgct cctctcggtc ctagaagtgg tcatgggaga gaagtcagcc ccaggacccg
60241    tagatcctgc cttttcacggg tgctacccct agcccagctc tgaccttaaa caccaaaaat
60301    gtttctataa ggaatatcta aagtgcccag ctttatggaa tgccagataa gactcagttc
60361    ctgcctatcc tgggagctc aactgagttg gtgttctagg ataatgaga gtggaaccag
60421    gcagtcctag aggccctgaa aaaatggaca gaggcacaaa gcaggtagtc agcaacagcc
60481    ctggagcttg aaaaacattc taggacctgg caaagaaagg atactagagg ctggaagaca
60541    gWggagctga gacatagcaa gcactgggat ctaaagggga aatcagtgca agtcaagagc
60601    ccaagaacag ccttcctcat cccctaggac caggccttcc ccagcaaagc tgttcgcttc
60661    caagatggaa gccctggcga gtccagacaa agccctaggc cccaagagaa agcaagccca
60721    acctctccat ggccatttct caaattatgt cagggcagga atcccagccc agctctgggt
60781    cacacagtac aagtgtgttc ccttcttgaa ggcaggtccc ttcgaaggtg ttcaccctcc
60841    tgtgctctgg tgctctttt gtacgtgact cccagaacca aactgagtgt acatggtgta
60901    tcctgatctg agcagtacag ctgtagccat gtatggtgat tcacaccagt aatcccaaca
60961    ctttgggagc ccaaggcaga aggattgctt gagtccagga gtttgagacc agcctgggca
61021    acaaagcaag acctcgtctt tgcaaaaaaa aaaaattagc tggacttggt agtgtgagcc
61081    ctgcagtccc acctacttgg gaggctgaag tgcaacgact gtatgaaccc agggtttgag
61141    gctgcagtga gctaggactg tgccactgta ctccagtctg ggcaagagag caagaccccca
61201    tctcaaaaca aacaacaatg gcgctgttcc ctccttgct aaaccacctg agtagcccat
61261    gtaaattttc agcagcccctg ttcctgctgg cctgtgctga taatcacaac ccctgaacta
61321    atgtaagacc aaaccaagct tcctcattgg tttggtcttc ctccttgtcc tctttcagtc
61381    ccctgttcta tctactgtaa tatttctgga tttgaccctg ccttgagacc atcagctgca
61441    aatccttgct tgctgtatca gcagtaaatg agaaaaacag acctgctggg tatctatcca
61501    acccataaag agcaagagtg ccctgaacaa agccaaggat Rggcccaggg ggacatcctg
61561    gctaatgctg actcaccaac cttcagtgcc agactcctca atgctcccct ccaggcctat
61621    ctcagttcct cagtctttcc tgctgcaggc cgcagctccc ctgcccacaa ctccacaact
61681    ctccttgtag agggctactt cctcctgccc tgcttaggga ggcccagcct tttcaccttta
61741    ctcttctttc tcaaggctag gttgcccaag tgtcctcagg caatttgatc cagttcccaa
61801    cagcaagaga cagaagctgt gggctttgcc ccatcacctc tataaactcc cagacaccct
61861    tcctcctaa atacataggc tcagtattaa agagctaaaa agacaaaatg tttgccaaag
61921    ataaaactat gtatttctaa ggaaagctgg ctccataatg aggcccaagt tagcttccta
61981    tgtgtcgtc ctcccagctc cacttcagac agatcttcct gcaggacagg gtagtctctt
62041    ccctatcagg ggttcttcaa gaagaaggtt ggctgatcac ttctgagcct tcagctaaga
62101    tcaagtgaac aacaaggtta ttttcttgaa acccagactt aaagaagagg ccatgctacc
62161    tacttcagag cagacaaaca tcaccccact cccaaagtgc gagtggagca tgggttaggt
62221    ttgtcacatc aaggtttgtc tctgcattag tgtaacccaa gaggcagggt ttcactgtct
62281    accttagcac agacatagca gcctgcccRt gactggccac ctggtctagg ggcatggctg
62341    agacagcttg gccccatgga taaagtacat ggcctagcgt cagaacacct gggcactagc
62401    acttctcagc ttggccaaat cacttagctt ctctgaactt cttcctcacc tttcaataga
62461    cataacccac actaatatga cggatgtctg gcaagagtca aattagataa ctgtgaaggc
62521    cctttgtaaa ctgtaacgtg ttgtatattt tttattatga taaagagaca gagatgagag
62581    tcggagaggg gcctgcccaa gaactcaaag agggactgtg ggatggtgga tggttatggc
62641    ccttgctaca tgaggcctca aatcacccag cagtgattaa gcaccttctc tgggtgttag
62701    gaacagaaat gagagccccc caaggagaag gtagagattc aggagagcag caggcccagc
62761    tctcccttcc aagtagaagc ttgtatcctt tctcatacgg cattaatcct tcttgactca
62821    ttccctgcaa gagtccatat tatgctttaa gggcaaattt cccactaggc tacagctctc
62881    ccagtaggca gggttattgt tgtctctttc tcaaaaaggt ggaagtgaag tgagaggtat
62941    taggcacaac acatgcctaa cacagggcaa aggaaatatg tgttcattgg gtgtatggag
63001    aattgagaac cagaagccac ccttgcttcc catacaaacg acatttttcct aggcttaagc
```

FIGURE 4-R

```
63061   ccttaatcca aaatacgttc actgaagaac gaactacttc ccaagtacca gtgatataat
63121   ctattttgt gaccatcttc cccattagac cgtgagctac ctgaaacctt tctactctct
63181   caggtctact atatgttcaa atgtagaatc cgggcttaga gacgatcaaa aaaggagagt
63241   agacagcaac ttgagacttc atccttgaat gtcaggccag gcagggcagg gattagagtg
63301   tggggagaag tgagaatgca ctaagaggaa gagggagaat ttaaaactgt acaggtctcc
63361   ccagcctaac cctttctcca aaggtatcag atctacagcc aaattctcag aataggcatg
63421   tctccagcta aaggaaccct caggccccag gcagactgca ctgaggcaag ccaaactcag
63481   aaccaaatga acttcccgct ccatttctct tttcccacaa tctagccaaa gctaaatcct
63541   ctttgttgct tcccagacaa tttcccacat gtcccgatgt cctcactgta tcgattaaat
63601   ccttcattgg ccaattcaaa ggccaccaac ttccagagtc gtccctggc cctagactag
63661   cagcgacctt ccttctgcaa ccccagggac taagacgata cacgaattcc tgattcatct
63721   caggacagac taactcaggg cctcagctta cccacccta aatggattc gcaaagccca
63781   ctaatacaca gaagacacag gaagctgggg aagggagtgt tcccggggga cctagactga
63841   ggatccttga atctgaaaag ttttgaaggt aggagcaaac ggaagtggtg ggagcgagcc
63901   ggacaggcgg ctgcctgcac accccgaggc ggggactgtg tagaaatctg ggctttaac
63961   aggggtagga gcccggcttg gcgtctcctc tgtaatctgt ccctccagg cctccgtatt
64021   cagtgagccc tgcagtccgg ctgccgtcc tccgcaggtt tctttctggg ccccatgccc
64081   cagtgtctta gccctcattc ccgagcccg cctgccgcgg ccgcacctgg tccgagtcct
64141   cgttctcgct gctgtagcag caccccatgg ccggggtcgg gccgggcgct caggccgcgc
64201   cgaggaggga cggcgtccgt gaggagccct tccggtcaca tgacccgcgg cggcctcccg
64261   caggcaacca cccgcccca ccccccgtac ccctgtccc ggagccgctt ggccgcctca
64321   gtcaataccc cggcttccgg tcccgcccgc tagcgcgtga tcgttgtcaa ccaatgggaa
64381   ggcgtaaccg tacacgcaag cacgtgatgc ggggaaaggg cggggcggat cacatgactt
64441   catctttcca gtctctaaac tggcagtagt ggccatcgtg aattgtgtta tgcgttctcg
64501   tggccactag gccacttttc tgggccattg agcgaactcg taccaaatgc cctcgtatgc
64561   ccttgtgata tactcttcta aatgccatgc gaggggcgac tgggatccag gcctgatgct
64621   ccagatcgta cggtctgggt gcacacacac agatgatcca gatgaccagt acctagtcgg
64681   ggaacacaga gggtgtatcg cccagctggg ctggggtga atacacagag ggtgtattct
64741   ccacctgggc tggggatctg cgacttacag gaagaaggga cctatacta ccttcacatg
64801   ctgacgcgca gcggagataa atcctggtag aggagataga agccacctca ctgacctctc
64861   tgctttcagg cttttatctt taattctgcc ttttttaaca gcacccattg taatcgaacg
64921   cacaaagctg accatcagtt tctcttttcct aacccccgct ccatgtcttc ccttgggccc
64981   tgaacacagg tccaagtccg tccaagattg tatagtgatc catttgttgt tcatgagcgt
65041   gtgattgggt gttcaccagc atgtatcaaa tgtgccaccc tcaaatcttg ttttggcaca
65101   ttacccgtct gacataacaa gagcctgaca cctctcccac tgcatgttct ggggtgaggg
65161   gtggaggggt cagcaatgtg tttcactgga catagagaaa taatgtagtt tcctgattga
65221   tctactggac tttgtacatg cagcctggtc tgcctactgt ctttactgtc ttcgagactc
65281   agtacaatgt cctcctgatt accttctctg actccattct ctggacatgc ccagctcct
65341   atgcttaatc ctcatccagt gttaattcat gcatttattg aatcaacaaa tatttgctga
65401   gcgtctacta tgtgccacac attgttatat ctggatatgc agcagttcac aaaacagcca
65461   aagtccctgt agtcatggaa catccaatag tgatcacact atattgtatt ctctgttcct
65521   gggtcagtct cacctaccaa acttgggagt tcctggagca cagtgacagg ttctgactct
65581   tccctgtagc caaggcatg gccttgctta cagaaaactt gcatatcaat gagcatgtta
65641   cagtcacccc atcaccttgg ctcaccccat gcccatctt ctgatccaaa gtattggaga
65701   agtcaccaga tctcatacct cttataaccc ctcaaatcaa gaccctgagg ttctgtaaat
65761   cttttgaggt tcctgaaggg taggaggcag ctcaagctcg tccctgggc tggtaacttg
65821   aactgcaggt ctcaggtgac agcagcagcc tcagcatgaa taattgaaag ccattccagc
65881   ctcctacctc agggttatcc cccgcagcag gccctggact ccccgacctg tcctgtgctc
65941   tggtcctcca gcccaggtaa gcagggccct ggattgtggg tcccaagct caccagttca
66001   agcccaccgc atcactcacc tattcacacc catccataca ctctttcatt tttactcccc
66061   gccatcacca ggggccttgc aagaaggccg gcaaggaggt cagatctgga tgaggaggag
66121   aatggtccag gacatgggag gagaggccca ttccccatag gtccctggag agaagagctg
66181   agtagaggga aaatgtgtgc tgtgtgttat gtgtatgtac acattgtga agggaattct
66241   gagacagcac aggagaagag gggaatacag cggagaggag atggggctgg agaattatta
66301   aagaatcaaa gactcctccc atcctcaggg aagagcaggc agagggagag tcctggggtg
66361   ggaaagagga catctcactc taacacccta tggggtattt tgattgcatt ttactgaggc
66421   agggcacagt gatagtgaag gtgttttga ctgcaaatct atgctctttt gctacacagc
66481   agtggtcaga ggagaccagg caggcagagg gtaggggtgg gggaagatat cccagaggtg
66541   aattagtgaa aggggtcctg aagaagggg gacttcaagg ataaagagaa acaagtcagg
66601   ggaacaatgt gaagatggga ccaggggttg ggaccgggaa gaggtggttt ggggctggt
66661   gctgaaagta gacagtatag agtccttgaa agtacacagg cttggaatca cactaacctg
66721   gattcaaatc ccagttctgc tctgtgactc tggacaaaag acttagcctt tctgagccgt
```

FIGURE 4-S

```
66781    ggtttgtgaa atataaggat aataattgct actggcaaaa gctacacaaa taggcaaatt
66841    gtgggtatgg gattccctcc ctacctccct ccacccagg gcccaggtag ggaccatgtc
66901    ccctgccatt gcattggcct tcctgccact ggtggtaaca ttgctggtgc ggtaccggca
66961    ctacttccga ttgctggtgc gcacggtctt gctgcgaagc ctccgagact gcctgtcagg
67021    gctgcggatc gaggagcggg ccttcagcta cgtgctcacc catgccctgc ccggtgaccc
67081    tggtcacatc ctcaccaccc tggaccactg gagcagccgc tgcgagtact tgagccacat
67141    ggggcctgtc aaaggtcagt gttccctagc cttctgctcc aagaagtacc cccaagacag
67201    tgaaggaata tttgggatct gttgctgctt aactggatga attgggcagg ttcttgatcc
67261    tcttttaggg cctctttttt ttctcatctg gaaatgagga gcttggacta agtcatttat
67321    tcagcaaaca tttattgcca cctcttttgt attaggaatg tgctaggtgc cagggagagg
67381    ggtagaggcc acagagatga atgagccaca aatgctggcc tcaaaggaac cataatacac
67441    agtggaataa ccatctcagc agataaccca tagctttgta attatctgtc tccacatctt
67501    tcctctccac catggaggct tccacatacc atttgggta gctgtctgcc tggatttatc
67561    tcaatcccag cataagtgct tttagggtct tatttaagaa attcggctgt gtggtggctg
67621    gtgcctgtaa tcccagcact ttgagaggcc gaggtgggca gattgcttga gctcaggagt
67681    ttgagaccgg cttgggcaac atggcaaaaa cccatctcta caaaaaatac aaaaattacc
67741    caggcatggt ggcacatgcc tgtggtccca gctacttggg aggctgaggt gggaggattg
67801    cttgagccca ggaggctgag gctgcagtga gctgtgattg tgccactgca ctccagcatg
67861    ggtgacagag caagaacctg tctcaaaaaa aaaaaaaaa agaaaaagaa aagaaaagaa
67921    attcactggc tgggcatggt ggctcatgcc tgtaatccca gcactttggg aggccaaagc
67981    aggaggatca cttgagccca ggagttcgag actagcctgg gtaacaaagc aagaccccg
68041    tttctacaaa aaatttaaaa attagccggg tgtggtggtg agtaactgtg gttccagcta
68101    ctggaaatgc tgaggtggga ggattgcctg agcctgggtg gtcaaggctg cagtgagccg
68161    tgatcatgct actgcactcc agcctgggca acacagcaag acttggtctc aaaaataaat
68221    aaataaaagt tcatccaatt ccaagatcag aaatacattt gatgagcaat aaaaggggaa
68281    tgaaactaca aattctaaca gagacctttc ataaatctga aagataggt ggttgtttct
68341    gcctgggact tcatggagaa agagcaacat ttgaactgaa tctggaagtt ctgagttggc
68401    caggcagatg gcgatggggg tgggaagggc aaagccagcc acatatacac atgtggcatg
68461    aaggaatgag acagcttgat ggattctggg cacagttgtt tgggatggct gtgatacagg
68521    ccacaggtgg gaagtactga gagatgaacc tggaaggta ggataggatc aggtccaagg
68581    tcctgaatgc caggctgaga atcccaagtt caatcccaaa ggcttcagc tcacaggagc
68641    caaggagtaa taaggtcaga tttgttggaa agattccagg gctggtgtga agactacact
68701    gtaggagacg gggaccagga gggcagctgg ggctatggta caagagacag atgagacccc
68761    ggctggttgg gagctgcagt gaggcaggta ggcatttgag atatctttta tcaggggccc
68821    tgcatccatc tcccatgtct tctgcaacag ccatctcccc tcataggtca gatcctgatg
68881    cggctggtgg aggagaaggc ccctgcttgt gtgctggaat tggaaccta ctgtggatac
68941    tctaccctgc ttattgcccg agccctgccc ctgggggtc gccttcttac tgtggagcgg
69001    gacccacgca cggcagcagt ggctgaaaaa ctcatccgcc tggccggctt tgatgagcac
69061    atggtcagcc tccatctcc caacccaga ttttgtcac cccaggcctt gccccagac
69121    atcccttgtg aaggactccc atctaaggag aaggaagcac ctccactctg gggactgtga
69181    tgctggatgg tgtgtgagct cctgccctcc tgtcccaagt catctgcaca ttatttctg
69241    ccggatgacg aaagaaacag ctaagaggaa ggtctctgga acccagcaaa tttgggtcca
69301    gctcttactc tgcctcttgt tagctacgtg accttgagca aagcatgcat cctctgaacc
69361    ttagcttctt cagaatggaa atcacaatac tgatcctgac ttcttaggtt ctgaggtcag
69421    aggaaatgtg agaacactca tgggaagcta agccaggacc tggcatgaag taagccagat
69481    cctggtgggg tcttgactgg gagaacaatt cccccaccc tcacctccag ctccccctat
69541    ccccacaggt ggagctcatc gtgggcagct cagaggacgt gatcccgtgc ctacgcaccc
69601    agtatcagct gagtcgggca gacctggtgc tcctggcaca ccggccacga tgttacctga
69661    gggacctgca gctgctggag gccatgccc tactgccagc aggtgccacc gtgctggctg
69721    accatgtgct cttccctggt gcacccgct tcttgcagta tgctaagagc tgtggccgct
69781    accgctgccg cctccaccac actggccttc cagacttccc tgccatcaag gatggaatag
69841    ctcagctcac ctatgctgga ccaggctgag gtccaggccc aggggtactt actgatgccc
69901    accccaccc ccacccaagc agggacctca aaatcccctc cctttcctgt ttggggcctt
69961    gacacacgct gggctcaggg ctaggagtc tctcttccca cctctgacct ctttcagcct
70021    ctacactgac ctcaagtgtc aagttctatc aggctgcttg gtctcactag gcccctctt
70081    tccagagaga accatggact gacagcaaga agcctgagct cccgacccag ctctgtcact
70141    gatttgctga gtgactccaa gggaatcccc accttgctct gagatttaat cttctctctt
70201    aacacgaagg aagctggatg ggagagctcc aggggcctcc cagttctcgg cctcagaaag
70261    cctcccatcc tcagcccatg ccattctggg tgggatcaga ggaagtggca atgagttaga
70321    cgccctgcag gaatagcctg atgcaagctg ggccagagaa aatggcacag aaccctggac
70381    ccagggccag ggatgccctg gccttcccta actctggccc acctagccaa ttaggtgtgg
70441    ctgatgtccc ttgagtgccc tcttcctaaa gcccaaaaga agatgctgga ctcctctggg
```

FIGURE 4-T

```
70501   ccccaccaac aaatagggaa tagacatggg tggaaaatca ctcctttgtc tttattaaag
70561   aaacttagac cagacctggc aatcaagggg tgaggtactg gccaggaagg tggagtaggt
70621   ttcaggccct ggggatttca agtgcagact gatggcctgg gaggggccaa agagaccaga
70681   tcctggcagc agctgaggag gtgcccaagg gcactttcag gcactggggc catcagctgg
70741   ttctgtgggc aggggttggg ggttgggatg cagggtagtt tgggctggcc tggaatctcc
70801   ctgaggccac cctgccttgt ctacctagat catccactgg tcctgatcct gttcgttgcc
70861   ttccatgtcc acctggagag gaggctgggt gtgggtgggg aggggcctca gccagcctca
70921   gccccagatc ctgcccctgg ctggatccag ggtttctgta ccccttggcc atcaactggg
70981   tcaggagcaa gggtccagga acagaggccc tcccccatac cccttgccta cctcattgac
71041   ctctccatca tccggtgact cattgtagtc attcatctcg tccatgtcct gcatatcctc
71101   atcatcctct gagtcctctt cactatcctc atcatcttca tcatcctctt cttcctcgtc
71161   atcatagtgc tggtgggcag gacagagcct gtaagcccta caggcctgca tggaccagtt
71221   caagaactga cccacttgag cctctctcta gggcaatgaa atgacccct accccgacac
71281   tccctccttg agtctagcag gctggtgcat gttctgcagg accttaatgc taggcccaat
71341   gcccacccct tctatctccc cttttaggct tttacccaga tctgagaacc acaactgctc
71401   tgggtcagag acaggacatt cagaattaga gcagaccctc ggtccactgc ggcccccaca
71461   caggcccccac ctgctagagc cactcaccct ctgaggctgg ttgccaatag gaaccaggtt
71521   gttgtctttc tccgcgatgc tttggagctg tgggcaaagg cacagaggaa caaggccaga
71581   gcccaagtag ggcaggtcag gggcatggga ctggcccatt ctgcccagaa gacaacccac
71641   acgtgttggg gagaagcttc ctcccagttc tcagggagat acaatccctt tcttgtcatc
71701   tgccatttat gaacttgatc caaatactta aactctctga gccttctttt ttttgtataa
71761   ttatggtgag gatgaagtga gagacttatc agcctagaaa gcatcatctg ctagatcctc
71821   aattaatagt caaaattatt tcctgtgctt tagggaaaag agcttgggct gagtgtcagc
71881   agcctgggct ctaatctggc ccagaagtca catggtaccc ctgtaaaata gggtaccaca
71941   agatgagaac cttggctccc tggctcccag cccgattatt cccagctcag ggcaaaaagc
72001   tcttcctggg tagatttctg gagtaaggct gggtcatggc ccactgaagg aggtctctgt
72061   ctgtgctgag gtctctgtgc tgtgctagct gctcactcac ccaggcctga tgctgctgtt
72121   cctgctgctg cagctctgtc tcttccacac agggtcgatc cagattaaac cacagagtct
72181   cagtcacacg agggaagagt gaggggaaca aagtggacat ggctcctaga ctgagggaaa
72241   gggtcaagtg aatgtgtttt gctttgtttt tgttttttaat ttggttgtaa tttgatttRg
72301   ggataggggtg gaagacagca ggaaagcagc ccctccccct aggaatcaga cagacctggc
72361   tttgagtcct ggctccacca cttactagct gtttgacctt ggctgagtca cttaacctct
72421   ctgagcctca gtgtcttcat ctgtaaaatg gggataataa caattatacc actgtcaaag
72481   ttattctgat aattaagtaa ataatggatc aacaaagctg tttgcaggct gttcaaggag
72541   ggatgagaat gggagtcaag tgtagggata ggaatccaga atgcagactg cattatgaa
72601   attatacaaa attagaggta gcagggttct actgaaacta tccctacctc ctccacacac
72661   taaaacctgc tttttgaccc tttatgatgg cccataccac acccacccag tgtcagaaat
72721   ttaggacact aacgacctct catgaatcac agccaaatgt cggggtggag ggattgtagc
72781   atatgcaagc agggttcagt aagacattct aggaggcatg aataagtgga taaataagta
72841   gatggaagat tgaatggatg aactaacatt ataagggtac aatcagcttt gagcggctga
72901   gggagccgac caggagtgcc agataatctg aattaaactt aggacaggcg aactgaggcc
72961   cagcgacagg cagagactgg ctttaggtca tacagtgtgt cggggcttag aattcctccg
73021   tgaaagggat Ragcaggaga aaataatcga tgcctggtcc tgcttttgtc ttaatttatc
73081   tgaccgaccc agggccagcc gctgcccttc cctgtatctc agattcccaa cccgcgtaat
73141   taggcacgac ggtaaacacc ctcatgtcca agaagtactg acagaccagc gatctcggct
73201   ccgaaagccc aacccaccgt cgcaaagcca ccgccctttc tttgctcatt acgataatga
73261   ccatgcagtt gaccaacaga aagaaagcag ggcgggtctc agacagaaat ttggccttat
73321   agggttgcta aacgcgaaaa aagcggggcc tgggtaggac caattaactg aaagaaatgc
73381   tgggtgacag gaagtgacac caatgaatga cggaccttgt gtgacgggt ggggcttagt
73441   ctcgaggaag cggccaatga gctggagctc tttaagggtt aaggactctc aatatggagc
73501   tcctggggag tcgggtcaaa ggaaatgggt ttctctgggg gaaaaaggaa tgaaggggca
73561   aggagacggt tgcagccttg cgtctgtact taccgcgccg ggaggctgct gccggcggcg
73621   acccggaagc gcttcaccca gcctgagcgg aagaacccac cagaatccgg gactcaccaa
73681   acgcatgcgt ccttcgtctc ctttttgtttt ccccgctccc gcccactaaa ccggatgtga
73741   cgttgaccta ccttagtcac attgttaggg aaggaagtgt gccgcgccta cctatctgcc
73801   ccScccttgag tctcagccag tcggcgtctc catcctggcg ccagcactac ggtctcgttt
73861   aaccactgcc ccgtttaacc cctgcccttt tgttgccagt caccatttgc ttgttaaccc
73921   cttctgaaga agagctgaca gcaaccttt agtgcgaggg ccattcgtcc tgctgcatcc
73981   cagaaaacta atctgttact acttcagaat tgctggttga tgttaggccc ctccatctg
74041   tgctctctca gctacagttt cccgtttgag catattcatt cttttttatt tttgctctga
74101   acaaaaatat tagagttaca atattactat attccaggcc ttgctagaaa ctggggataa
74161   atctaggaat atggtcgctt ccctggaaga cctcacagtc cagggaagcc aaaccctgca
```

FIGURE 4-U

```
74221    gacatgcagt agacttagtg gtctctctta aggttgcttg ttgagttttg acattggaga
74281    ttatgtacag acttgaatga ctagttagcc tcaggcacag cattctgttg ctgggggaat
74341    cagctgccct cctcaggcct gggccaagta cacttagaga tcgccctcgt cacctctccc
74401    atcctttgct gatgcctctg ttctagtaac ctctgactca gcttcgcctt tagagatact
74461    catgctttct ggcaacagag gtccttcaaa cccaattcct attaaactcc atcacttacc
74521    agcctctttc agggacagca gttatccgca tttccagtac tgtcctggcc agatgtgtga
74581    gttttggcaa ttccttttcc tctctctgga ctcagcttct ttgtcaacca gcatcataat
74641    ctctgcccag ccttccttct atcctgggct gatgtgaaga ttggataaga attgttcaag
74701    aggtcgtgta ctgtgcatat tgaatgtgat tatattgcca aatagcactg tttgttatag
74761    tttttcatta aagagtaaac tttgcctctt ggaaatgact accttttca ttcattcaac
74821    aaatacctac tgagtgcctt agtatatgtc catcactatt cttagtagtg ggtatacaat
74881    agtaaacaaa acagaccaaa aaagtccctc ttttcatgca gccttcattc tgagagaggt
74941    aaacaataaa gaagatagat aaataaaata tgtagttgta agattgcagt aaataagaga
75001    aaaaataaat ctgagaagtg ggaataaaat atttgcaggg gaggtgtttt atttcagact
75061    gggggccaa agtcactggg aaggtgactt ttgagtaaag gtctgaagga gcagagagcc
75121    ttctgatatt tgtggaagag catttcagag agagagaata caagtgcaga gggcctagaa
75181    tggcttgggc atagtgtcct ctagggagag taataggtag gagatgagga gttggggagc
75241    cagtggaggg ttgtgagcac agggtccaca caatctgatt tacagtttaa ctgagttact
75301    ctggctgttc tccaaataga ctggggtagg ggagacaatg gcagaagcag ggagaccatt
75361    tgggagccta ttatgataat ctagaggttg tggatgagaa gtggttgaat tctgaattta
75421    tttagatggt agagactaca aggtttgcta acagatggac aatgccagaa taagaaagga
75481    gccacgattt ttgggctgaa cgactagaag attggtgttg ccactttttt gagttgggaa
75541    ggaatgggga ggtgatgagg ggtttggttt ttttttgaca gggagcttag gtttgagtgt
75601    gttgagtctg agatgcccat tagagtagag atgttggggc ggcaggaagg catatgagtc
75661    tgcaggtcag ggcagagatc tgggctggat agatcatttg ggagtcattg gcatgtagat
75721    ggtgtttaaa gtcatgagac tggatgagat caccaaggga gtgaatgtag ttggaaaata
75781    gtttcctcca atattcagaa tttgaggaaa ctaggaaaag cagcaaacca gatggagaag
75841    gaaggccaaa aagataagta gaaagctggg tgagttgatg gtatcttgga agccatgtaa
75901    agaaagggtg gtaggagaaa atggtttact gcagcctcat tctgtacaaa attgtgcttt
75961    tgtttatttc cccaacagac catgagctcc ttgagggcag ggactgaatg gttactatgt
76021    ccccagggcc cagcatgacc ttctcctgga ttcctcatct tccttctgtg acctgtgtct
76081    ccatcagttt ctcctccggc atcttttct tacaggattc ttacctcagg taccatttgc
76141    cccgtcctc ctgataattc cgcctgcgg aaattccta gtaacagagt ttcttttcag
76201    ggtcatcagc caggctcagt aagtaatgat gactggttag ctggtgacat ttattgagta
76261    ccaactgagt gccagacacc tttctaggcc ctggggacag aggggaagca gaaataattc
76321    ctgccctaga gaaaaataga gtatagtgag tactaagaca attatagaca attatagagg
76381    agggtaataa atgttaaaat caatgtatgt agagaataca tgagaacaca gaggagggat
76441    tgatgaatgg gttctgaaca aactaagttt agactttgt tccagaaaag gaaacatttg
76501    agtgggcctt gagggatgag taggagttaa gcccactggt aaataagtag gaaaagaggg
76561    tgcacaaaga ggcatatttc attcaagggc atgtttggag aacattgaga atctgggcag
76621    aactagatat gtggagtgga gaaagatgag aaagaatgat aggggaccca gatagggaag
76681    gtctttggtg gccctatatg gagtggatgg gatgggatct gggcatcttg ggtctcacct
76741    ttgtcttatt gccgacttgc tggggacccc aggtagatgt ctccccattc acaagcttcc
76801    gtgttctcta acataatatc taaccatgtc gccagctctg atgtgagtcc ctggaaggga
76861    ttcccctagc ttgatccttt ccattcttag attttacat ttgccttatt tgtgatttat
76921    acaaaccagg gcctaggaat ggaaagcagg gtcaggatgg agatttctca acagaaatca
76981    ataaatccag agcccagagg ctgaagatgg aaaccatgat tctatgcaga gaattctcta
77041    ggatccagga agggccagag ttgagtggtg tgaattcagt gctagtgaaa gctgcttact
77101    cattccttcc ataaaccttg aggagcatgg ctgaccctgg taggggacag gggagaatgt
77161    aacagtcaca gtcactacct ttcatacata tggagggata gttggtctcc agagagtttt
77221    cccactcata gtctccactt atccttagcc cagccctggg gattctgcct tcatttagca
77281    gatgaggaac ctgaggctca ggaaagtaaa gcggcttgtc tgagttgaag ctacaactca
77341    agaatgtcaa aatcttgcat tgttccacaa atcttcctta tgggctgata tgtgcttgcc
77401    gatggggact cacagaggaa ttcgatttga gtccagtcc tctgcaacta cccagtatgg
77461    tgtggatacc agactaacgc aagtcattag gcccttgagg ccagatctct gtgtgattca
77521    tctgtatttc cccggcacct tgcacagtgt ctagcacaga gtagccactc aacaaatgtt
77581    tatataagat gggttttttt ccttgggtct aatggaatta tagttcacgt gatgaatggt
77641    ataacaggga taggttctaa aaagagaaaa gtgggaatgt taaaagtga agagcagtgt
77701    gggagggag gtgagaaggc ctcctcagag aagatgagac cttgcaagag gagttaggaa
77761    agaatattct agtcaagagc agacagcatg tgcagaagtg cagaggcctg aaagggtgtg
77821    gtgtgcccag gacatggcat tgaccgaggg cctgttgtgt ggccatcgtg gtgatgtgca
77881    ctgtgaaaga aacaggacca ggagacagta ccctgtgctc aaaggacaag gcacagcctt
```

FIGURE 4-V

```
77941    ggaggaggac agggacatgc tgagaaaggc ttccttgagc aggggagact tctgctggt
78001    catgaaggat gcttcatagt tcgagtcaga gaggaggaaa gaggaaacct cccaggtgtg
78061    aggggcctcc ttaggcaggg gctgtggttg aaggaataa ggagaatgcc caggcaggag
78121    agcatggtgt gtggagggca ggctggtcgg gtgggagggg ctgcagagct ccactgggtg
78181    ggctagctga gggagtgcac cttagcgtgg agtataaggc ttgttctgcc tcatggtcac
78241    tcaacacctc atttatttcc catcattgtg gcctccctgg acctgactct gagtttggga
78301    tggatagatg cgttggaagg gatctctgtg aattatcttc cagttcccta gaaagccagc
78361    cccaggagag gtgctccagc caggtccctg tctgcatggt ggttttgcgt atgtttgctt
78421    accacaaata tatggtaagg tttcctcact aaggtttaat gggctaaggt ttcctcactc
78481    tgactacagc aaaatagatg caaagtttga agagaggccc tctgcattgg aggcaaaggc
78541    tgaggagaca cagacctaca cacacacaca ccccccctca ctttcatgca gaggtggtag
78601    gcagaatgaa ggctccctgg agatacccat gtcctaatcc tatggtgtgt atcctacctg
78661    gcaaaaggga ctttgcagat gtgattaagg ttaaggactt tcacatgggg tgattatcca
78721    ggtgggccca atctatttac atgaatcctt aaaatcagat aaaactttcc cagctgtggt
78781    cagaaaacaa gacgtgacaa ggaagaagca tcagagagat tctacattgc tgactttgaa
78841    gatggaggaa agggccatga gccaaggaac acaggtggcc tctagaagct ggaaaaggca
78901    aggaaacgga ttctccccta gggcctccag aaagacctac tgtcaccctc attttttttt
78961    aatttttaa tttttttgag acagtcttgc tctgtccccc aggctggagt gcaatagtgg
79021    gatctcggct cactgcaacc tctgcctccc aggttcaagc gattctcctg cctcagcctc
79081    ccgagtagtt gagattacag gcgcccacca ccacaccccgg ctaattttg tatttttagt
79141    agagacgggg ttttgccatg ttggtcaggc tggtctcgaa cccctgacct caggtgatcc
79201    gcctgcctca gcctcccaaa gtgctggtgt gagccaccgc acccggcccc tgacaccta
79261    aattgagacg catgttacac ttgtaacctg cagaactgta agttaataag cttgtgttgt
79321    ttgctgggca cagtggcaca ttcctgtagt cccagctact cgggaggctg tgataggtgt
79381    gttactggat agtgctctgt aatttcaggc tcttggtgtc ctgaacaaag aactggacca
79441    gacacacaca gatattaagc acagtattac actcttagag ggggagagtg gactgacctc
79501    tggcagatga gatcaacatt agttttgtgt actctgggtc tttgtgtgtg tgtgtgtgtg
79561    tgtgtgtgtg tgtgtgtgtg tgtgtgtgtg tgtgttctct tcccaaggct gcctaatctc
79621    tagccagtgt ctgcctttt gattgataga tgtgttgctt agttactttg cccttgtgt
79681    gtcacctcca tcccataatt ttaagtacat gagtgatttg cagtccatat gcatgagctt
79741    caatgagcta attaccaaac ggggtcattt taaggatact ttttctcttt aatgtgcatg
79801    cccatctctg aggagctgcc cgcaacaggt ttggtccgga tttagcccag atgggggctt
79861    cttttttcact tttgttttgg ctgttctggt ttttatctcg cttcttgctc acctgcccct
79921    tcacctggct tctgctccct gcttttactc attctgccct tgatccaaat tttaattccc
79981    tttgctattc tcctgctgta ttttcctct tcccctgctt caggaggatc gcttgaaccc
80041    tgaagtttgg gaccagcctg ggcaacagag cgagaccttg tctcaaaaat caattaatta
80101    attaatttgt gttgttttaa gccacttagc ttgtggtagt ttgttatggc accaacagaa
80161    aacaaatgca caggtacaca cgtatatcct cccaccctga tagacaacca cagtcataca
80221    cgctcaggca gatacaggca gggagaccca ggaacatcag ctggccctaa gtgggggctg
80281    gggagaaatg aagcttcagg tgtgtgctgc ggggtgggtg gtaaggcctg ctccttggct
80341    ggtgtggaga aactttgacc acatttctca gtcttaactt tgctctgctt cctctcagtc
80401    cttacgtcat acttttagca accttttacaa caacatttg tcctaaaccc tgttgcaaat
80461    acatgtatga acctcaaaga ctatatatta aatgaaataa gccagtcgcg aaaggacaaa
80521    tactgtagga ttccactttt ctgaggttcc tggagaagtc aaattcagag acagaaaata
80581    ggatggtggt ttccaggggc tggggagtag ggagttatta ctgttttggt atttttttgt
80641    ttttacagat atcctgtttc tacttaaaga gttattaccg ttgtcaagct gggcatggtg
80701    gctcacgcct gtaatcccag cactttggga ggccgaagtg gcagatcac gaggtcagga
80761    gatcgagacc acgctgaaac cccgtctgta ctaaaaatac aaaaaattag ccgggcgtgg
80821    tggcgggtgc ctgtagttcc atctactcgg gaggctgagg caggagaatg tcttgaaccc
80881    gggaggcgga gcttgcagtg atccgagatc gcccactgca ctccagcctg ggcgacagag
80941    ccagactccR tctcaaaaaa aaaaaaagag ttattaccat tgaccatgaa caacacagt
81001    ttgaattgca tggtccact aatatgtgga ttttttcaa tcacagataa aaaatacagt
81061    attcagaggt tgcgaaaccc acatatatga agggtgggac atcagtatgt gtggatttgg
81121    gtatggggg ctcctggaac caatccccta catctgttga gggaggattg tatttaatgg
81181    atacagtttc agctggggaa gacaaaaagt gttctggatg agcctggtca tggtggctta
81241    tgcctgtaat cccaccattt tgggaggccg aggtgggagg attactcgag cacaggagct
81301    caagaccagc ttgggcaaca tggcaaaact ccatctctac caaaatacaa aaattagcc
81361    aggtatagtg gtgtgtgtct gtggtcccag ctacttggga ggctgaggtg ggaggattgt
81421    ttgagcccag gaggtagagg ttgcagtgag acaagatggt gccattgcac tccagcctgg
81481    gtgatagagc aagaccctgt ctaaaaaaa aaaaaaaaa agagttctgg atggattcac
81541    aacaatgtga atgtacttaa tgtgagtgta ctgaactgga catgtaaaaa ttgttaaaat
81601    gataattttt attatatgta tgttgtcaca attaaaaaaa aaacaacatt gtagattagg
```

FIGURE 4-W

```
81661   caccattttg gagaatgggt tcggggagc ctccagtcga acttccccac tgcagtgcag
81721   ctggaaactc agtaactggt tctctgacac ctccccgcca ctcccacccc agtgccacat
81781   atccccatct ccatgcccca ctccagtcca gagccatcta tcgcctgggc tactgcaata
81841   actggctagc ttcccgccac accacttcaa accatacgtg gctgcctaaa acctttccct
81901   ggcttcccat tgcttttagc ctgtgagttg aagtccttgc caggcaagat ctgcccctgc
81961   cttcctgtcc accctcatct agagccaacc tcgtccttgc tttctgcacc ccaaccacac
82021   cccaacagtt ttgcagatct tcagacccac taaaacatgt tctgcctcag ggcctttgca
82081   caatgctccc attgcctggg actctgtcct tcttctttac tgggtcagct ccctccRttt
82141   tggtctcaag agaggtcccc cctgcagatt agctctggtg caaggagcac tcttccatag
82201   catcttctct tttcctcatg gcatctcacc taatacatac actcacacac acatttatgt
82261   gtgtgtgtgt atatgtgtgt gtatatatat aaaacatata ttttatatat aaaatatatg
82321   ttttatatat ataaaatata ttttatatat aaaaaatatt ttatatatat aaaacatatt
82381   tttatatata tatataaaat gtatggtaaa atatatgtaa caaaaaattt acaatttttca
82441   ccttttttt tggacactga gtttcactct tgttgcccag gctggagtgc aatggcgcga
82501   tcttggctca ccacaacctc cacctcctgg gttcaagtga ttctcccacc tcagcttccc
82561   aagtagctgg gattactaca ggcacgtgcc accatggcct ggctaatttt gtattttttag
82621   tagagacggg gtttctccat gttggttggg ctggtctcaa actcccgacc tcaggtgatc
82681   tgcccacctc agcctcccaa agtgtggga ttacaggcat tacagcactg ccccggccaa
82741   ttttagccat ttttaaatgt acagttcagt ggcattaagt acattcacat tgtgtgtaac
82801   catcactaca tccattcccc agaactctca tctttcccag ctgaaactct gtaattaaac
82861   agtagctccc cacccagcct ccccaagccc ctggcaccca ccattctact tagtctctat
82921   gaatttttac tactccaggt accttaaatg gaatcataca gtattttct ttttgtaatt
82981   ggcttatttc acttagcata atgtcttcaa agttcatcta tgaagctgtt gttgcatgtg
83041   tcagaatttt cttccttttt aaggctgggt aatagtcatt tgtacatatc acatgttgca
83101   tatccattca tcttttgata aacatttgga ttgtttccac ttttgggcta ttgcaaatag
83161   tactgctata aaatgattg aacaaatacc acctatttta actatacatc taattgtgtg
83221   cttattcgtt taaattgtgc ctctcttcct catctctggg catcacaagt gttcaccagc
83281   atatcctcag cacccagcac agtacctggg catcagtatt caacaagtat ctgttgaatg
83341   aatgaatgag acaccaaaat atacctactg gacatataca gtgtctgtag tgtgtaagga
83401   agagcagagg acttgaatct ggggcccagc tcattgattc ctcattgcgt gctctgacct
83461   tgaccaaggc ccttcacctt tgtaaaccaa agagtatctg agacaaatct caaccaattt
83521   aggaagtttg ttttgccaag gctaagcatg cacccatgac acagcctcag ggcgtcctga
83581   caacatgtgc ccaaggtggt tggggcacag catggtttta tatattttaa ggagacatga
83641   gacatcaatc aatatatgta agatgtacat tggttcagtc tggaaaagtg gaacagcttg
83701   aagtgggggt ggggtctttc ctggtcatag gtagttaaga gataaccatt tgcattctttt
83761   tgagtttctg gttagccttt ccaaaggaag caatcagata tgatatgctt ttatctcagt
83821   gagcagagag atgactttga gttctgtcta ttctttgtcc acaaattatg aggaaggtgt
83881   gtagttttttt ttcttttttaa tcttagtagc tattttttctt ggaatagaat gtgaggcagg
83941   tttgccctaa gcagttctca gcttgactat tccgttagta attgacttgg tcttagtaat
84001   tgacttttcc catagtaatt gacttgccct tagtaatttt ggggccctaa gatttattttt
84061   cctttcacac cttcaaacct cagtttcccc atgtgtaatg tagggcact atcagcccca
84121   cagagttctt gtcagggtca aacgaaacaa tacatgtgat aaggttcggc ttctgaccca
84181   aggaactgct cagtgaccta atctagaggc cttgatctaa gtactgaggg agagaggagg
84241   ctccaactgg gggagctgac tgactggatt cgaatccagc ccaaggtctg ttacccatcc
84301   tctggggacc ttggctctgt attcatttcc tgtagctgct ataacaaatt actacaaact
84361   tcttggctta aaccacacag atttgttatc tttcaattct gaaggtcaga agccataaat
84421   caatgtgtca gcaggactac attccttgtg gaagcttcca agaacaatca atttccttgc
84481   cttttccagc ttccagaagc cacctgcatg cctgggctgg tggcctccct tccttgtgtc
84541   cctctaacct cttgtttcca cctttatgtg tcctactact ctctctgagc tcctgcctcc
84601   ctcgcatcag gattacatca agtccattca gaaaatccag gatcatctcc ccatctcaag
84661   acccatttct taatcacatt tgcaaagtcc cttttgccat ataaagtagc attcagatgt
84721   tccagagatt aggacgtgga cacaggtacc atctctctcc catgtgggcc tcagtttgca
84781   ttttaggaaa ataagagcat tggtcatgcc ctgtcctccc tgtcacccttt gctctgtgga
84841   gttctacctg aggcaggaat attgggtgga ggccagaggg ttgggtcctg cctgcctgac
84901   taccctagca cccaaattct cacaatcttg tcaccagcag ttatagcccc agggcctggc
84961   tgtccccaa cccgtgttcc agtgccccac tgttcccttc catttcctgg gtgcttctga
85021   ttcaggactt ttttcctggac ccttcactgg actcacaaga ggggtgccct gtttattcag
85081   tccaccacgc tcaatctctt gcaggaggga gcacatgagt gagtgagtgc aggatctggt
85141   tggctgatcc aggtgctggc agcagcaagc tccatgcagg gccctcggcc agtctagatg
85201   tgagcgagca agggcaggat ccagccggct gctctgggca ctggcaggag aaatctccat
85261   gtggggcctg cggcagtgcc caggtggggg tgcccatgac ccctaagccc cagagggagt
85321   attacagtgc tctcctagtt ctgctgtcca tggacggtgg tgtgttagca gctcagttgg
```

FIGURE 4-X

```
85381    cccttgcat cgtctcatgg ggtggttgcc ctctgccagc aagggcaaag agccagtgtg
85441    acagcctttc tgggtaccca cacttggtgg gtcccgagcc cttggccagt gtccaagaag
85501    aatgaggttg tgcagacaat tgaagaatga tgaaggtgga gaatttttatt aagcaatgaa
85561    aacagctctc agcagaaagg ggagctggag aggaaacagg aagggccagt catcttcccc
85621    cgaagtcagg ccatctcttc tgtagtccag ccatctcttc ctcaaagtcc ggttgtctcc
85681    tcgaagtcca gccatcttcc catctactga ctgagtctgg ggcctttata tgcacaggac
85741    ggggagtgca tgctgattgg tttgtgagta tgcaaaacag gttaaagtga agacatcact
85801    caaagatggg catgacagtg tagaaaacca attaggaaag ggtaagtata tgtaaaatag
85861    gtgaaggtg gggatcaatc agaggaaagc acaacaaatg ggaagacaag tcttcaatct
85921    ggtctgagga tttagcttgt agcttggctt tcaggcttta aactggcttt ggcttggaag
85981    tggggtttca ccagggacca gtccctattt gcctaggcat ttggctgcct cctgtccctc
86041    tcatttcccc ctctgaagag gtacaactac ctgttgttag aatagggaca aagacaatct
86101    taactacttc ctgctgacag gggatgctgt tttgagcaaa cagcaatcag agctccctca
86161    gaggcctatc taagcgtccc aggttaaagg gagccatcat tcaaggctct gttcggaatt
86221    tgatggcctc taagtgagaa gaaacagttt gggttattag atgacatgga tcaaaatgga
86281    acaacaagga ggtaaagaca gctcaaaaat cccaagtctg ctgacatgcc cagataacta
86341    gtggctatag ttatgcctgc taagatttgg atgcatggtg cttggctttg gtttgctccc
86401    ttgtttcat tttcccaaaa aaacctccag attatgagca ccacatccta tttactccta
86461    tcagctgcag gataattgcc cagaactaga atattgattc atatttttac attacccatc
86521    ccctctattt cttctgagct acaaccagag atcactagtt ggttcacagg aataagcagg
86581    attaatctaa aatgtaggca aaagcttaaa aacaactgaa actagaattt aatgacaagt
86641    gtatgataaa ttttgaaaca taattttttct ctctccagtc ctcatttctg ttaaaaataa
86701    accatgatag gactgagttg tttgcaaaat aaactttagt cttatacttg gcctggtcat
86761    ttgcataaag tgcagcaaga ataatcattt tcacataggc ttttaaaatt ggctttgatg
86821    gaactctgtt tcacaaggaa tctcaggtag gaccttttaa agctgagctc agccatgggt
86881    ttgtaccctc aaatacctat gagttgggta aattcttctt tcttgaggt cccagataac
86941    acagggctct tgggcctgtt agaaaatgac attctctact caccacaggt taggaaccct
87001    gtccagggac tgtgtagaca aggtatgagg ccagttttcc caaggggatt ttattggctc
87061    tgcaagtcaa gcttgattcc ctaaaggaaa gcataccatt ccagtcaaaa ccttggtaaa
87121    ataaccggtt tctccagtta tatcctgctg caaaagaaaa tagattctta ttgcactgat
87181    gcaaataact atattgccat aagttaagaa tatttgcaaa tagtttccaa attctagaga
87241    aaccaggcag agagaaatat gctccaaatt ttcttcacag gagtatacct tactcaattg
87301    ttaaaagctg tagatagctc aaaagaagtt tccttgactc tggaaaaaac aaaaacaagga
87361    tcagcaatgt tttaagcaaa aagttaaaaa ggattacttc agttttctat tagttcagtt
87421    tattcagtta actcttgttc tgcttgatat tcaggagaat ttcagctctt tatgactcct
87481    gtatgttttt cctctgttcc aatgtcacaa tctccaaagt catcagaaac ctgcatttga
87541    gggcaccttt caaagtccaa tagctgtcca caaatcatct tttgaaaagg gtcaaaacaa
87601    gacaacaatt gtctgtgaat gacaaaatat ccttgggtag tcacagtcaa aaacacaatt
87661    gacaaagaaa tttgtttttt ctctgtggtt tacaataact taacacaata accttaatta
87721    ttactgatag catatactca gacatttgag ttttagaagg cccatacaat taggccgggc
87781    accatggctc atgcctgtaa tcccagcact tgggaggcc gaggtgggtg gatcatgagg
87841    tcaagagatc tagaccatcc tggccaacat agtgaaaccc tgtctctact aaagtacaaa
87901    aattagctgg gcatggtggc acatgcctgt agtcccagct actcgggagg ctgagggagg
87961    agaatcgctt gaacccctgga ggcagaggtt gcagtgagcc aagattgtgc cactgcactc
88021    tagcctggta acagcgcaag actctttctc aaataaatcc catacaattt ggaacatat
88081    attaatatta ttcactaaaa tataccctga agaaagtcat acattatttt tattttggca
88141    atcccatgta actaaatgtg ttaaataatc ctgtttacct ctcttttgga tgctccaggg
88201    gccttcagta gcatccaaaa gttagggggtt agaaaagaca accttgaacc tgaagtttga
88261    atttgggagg tctatcaaac acattaaaga tttaaaacac ttattatttt gaaatagaac
88321    tccagatcac cataagttat ttattttagc caaaatgatg actcaaaaat tttaaaacaa
88381    ggcaaaaacc tttcattatc ctttattatt acatgaaaat cttcttcgag agaaagtcaa
88441    atttcaccct tgcatgtaaa tccattttca gtagtctcaa ttacatgttg taatggtaac
88501    tcttagcaat ttttaatttt aatgtaaaac ctggtaagtt ttttaatta tgtactaggc
88561    acagataaag tctgactctt tacaacatag ttaatggtgt ggttaatcca tatgaccccca
88621    gaccttacca aattgtaaag ctggcaagtc aaacagttct caaaagccaa agaagcagtt
88681    tataacccta caacatttag caaacctagt atctgacctg catacattag accacatatt
88741    ttcattttga taacatttgt attttaccaa ttatcttcaa aattgttttt ctttctcaaa
88801    gattaaagtc acatgaacta aaaggcaata cagcttttgt ttttccttca aaaaatattt
88861    gatctaagca cttattttct ttaagcaaat tagagctctt tttttatata aacatcacac
88921    acaaataaca catatgtgat tacacagaca gaagattcag tagttgtaag atttttcatt
88981    tgccaatctc ctaattggat tattggcctc agggtggagc atttcaagaa gcagagctag
89041    gaaagcatgc agtttccagg gcctaataaa caggcatagc tggaagacaa aaacagattt
```

FIGURE 4-Y

```
89101   tgaaaggggt ctatctgctt ttaattcctg gggttctata agaaaaacag agtttttttt
89161   ttttttttcca aaatgggatc cgtggtgact tctctgtttt tcccaaggtg tcttatgctc
89221   tcagaagtta tcttagggcc tctcatgcat gcgttaagag tgacaagaca aattggggaa
89281   aaataattca gttgactgag aaaaaattgt tttgcagaga aacaagatcc atgaagaaaa
89341   aaacacaaag gcctttttaaa tatacctata gcttggatat ccactttttaa ttaagctgag
89401   cactctttaa gataacccctt ttaaatccct tagtacccaa ctttagccat gccaagccac
89461   gaatatttct ggcttttgaa ctttaccatt tctttcaaca ttttgcacag ggagagagag
89521   gccagaggcc cgactggcag aaaactttta cccttctgtc cacatgttca caattctttc
89581   cccttctcac tccatcctta ttccactctc agccttcctc atctcagtaa atagccaagc
89641   actcctctct aattgctcag accaacacac tctggagtca tcctaattcc tcccttttctc
89701   tcatgtcctc catctcagca aatcctatca aaacatcctt caaaagacat gacattactc
89761   ctcccttttc accacgtcca ctgccaccac atagccctgg ttcaagtcat ggttgcctta
89821   aggctgggcc attcacatag acatctgtgt caattgtttg ctttcccttg tccctagagt
89881   cagatcagat gctgaactgg aaaaagcaaa taaagtttcc atttcattca gagtaaaatc
89941   ccccatcttt gctgagtctg aaccacgggg ccctgaagat ctggcctgga ccccacacct
90001   gccgctccca gctcactgct ggccacactg gcctcctcct cgctgtttgt tcctgaaatg
90061   cactgagtac attttttgctt cagggccttt ggacctacgg gtccctctgt ctggagcact
90121   ccttcctcca tgttcacatg actccccttct tacctcatta tggtatcagc ccaagcatca
90181   cctcctagat cttttcctgta gaagatagta gccccctgctt catcactctc tgtccccctta
90241   gcctgcttca gttttcttca gagcacaatc atcatcttta tttgtttttct gtcgtctctc
90301   tctaacaacc tcccacccccc aaactagaat gtcagctcta tgacagtagg gactttttct
90361   tggtcacttc tgtagctcta gaacccagaa cagcctagca catggtagat gcccaataac
90421   taattctgag cttagttttt gaatgaatcc ccactctac cctcctggtc aaggcaccat
90481   catcccaggc ctggacttgt gaaacagctt tctaactggt ctaccttgcc caattccagc
90541   ctacacgtaa tcccatctga acacaccaag actgccaatt gaactgtgac attccctgc
90601   ttaaaactct ttcactgtga ccagttgtag aaacaacatt ttgtttatcc atttatccat
90661   ccgtggacac ttgggttgct ttcaactttt agctatcgtg aattaatgct gctgtgaata
90721   tgactgcaca gatagctgtt tgcatccctg ctttcaattc ttttgggtgt gtgcgcacaa
90781   gaggaattgc tggatcatat ggtaattcta tgtttaattt ttttttcacag catctggacc
90841   atttttacatt ccccctccac tagatatgtt attatataca aaggtggacg gctatacaag
90901   gacattcccct acagcattga ctataacagt gaaatatgag aagccactta aattcaatag
90961   aataatgaaa tagaatcata tagatctatg tacacagata agggaccatc tatagtacat
91021   tctgttaagt aaagcaagca aagtgagctg ggcacagtgg ctcatgcctg taattctagc
91081   actttgggag gctgaggtgg gaggatcact tgagcccaag acgtcaaggc tgctatgacc
91141   tatgattatg ccactgcact ccagcctggg tgacagagag agaccctgtc aaaaagaaaa
91201   agaaaaaaga aagaaatca aaatgcaagg gaattagggg ttattcttct tcctgaggac
91261   tggtgccatg gcatccagag aaagaacatt ggtggggata ctgatgaaaa agaataaagt
91321   ttgtagatta gttaaagta ttcccttaat gttaatttcc tgattttttta agtaattggg
91381   ctttggtttt gtcagatgcc aacatttggg gaaactggat gaaagcatat gggaaacctc
91441   tttactactt ttgcaatttt tctgttaagt ctaaaattat ctcaaaacac taagttaaga
91501   aaatcaaata aacttgatgt cttaaaacaa taccaattag gctgggcgca gtggctcatg
91561   cctgtaatcc tagcaatttg ggaggctgaa gtgggccgat aacctgaggt cgggagttcg
91621   agaccagcct ggccaacatg gtgaatcccc acctctactg aaactacaga aattagcctg
91681   gcatagtggc atgtgcctat aatcccagct acctgggagg atgaggcagg agaatcactg
91741   gaaccggaag gcagaggctg cagtgagctg agatcacacc actgcactcc agcctgggg
91801   acagagcaag actctgtctc aaaacaaaac aaaacaaaaa cacaatactt atttacttat
91861   acttcaagat tttgtgagtt taattatact tcaagatttt gtgagatttt gcccaagaat
91921   ttgggcaaga ctcatgattg gcccatcttg gccgggcgtg tggctcacc cctgtagtcc
91981   cagtattttg ggaggcctag gttggaggat tgtttgagcc caagagttga agaccagcct
92041   gggcaacatg gcgaaacctc ctctctacaa aaatacaaaa attagctggg cgtggtggtg
92101   cgtgcctgta gtcccagata ctcaggaggg ttgaggctgc agtgagccat gatggtgcca
92161   ctgcactcca gctggggtga cagagtgaga ccctgtctcc taaaaataaa aataaggta
92221   aaataaagat tgcccatct accctcaaca gttgcctgga ctccctgggg ctcagtgcac
92281   ctagatgctg gactcggata accatctgat ctttgatgta gtggacagac actttgttct
92341   tgccatcatc tttggtacct gagatagaaa gccttaaaga gaggccacgc ccatgattaa
92401   gtttcaggtc aaaacaacga gcaaaaggc aacggctata gttgtaggtg tagcaaatca
92461   gtgtgccttt tatctagagg ctactgaaaa ccagacattc attaaagata ttctggtcac
92521   ttggatgaag gctgcccttg gcattcaccct gaatctttag tagagtcttt agcaccattg
92581   gcaactcagc cagacctggc cttggccacg atagtggagc ctgggattgg agggcatgaa
92641   ttttatgaag cctgtaatat cagaaattcg ttggttgagg acatacctct ttcttttttgg
92701   accctgtggg cgtaatgcta ttgatacatg tgcagaggag gaattaatat gactgtgatt
92761   gacagaataa ttatgaagtg caaagaccctc agatctgtga tcagcttcca tagaagtatt
```

FIGURE 4-Z

```
92821    tgctcagaag cttctcagaa acattctcat gattgaagaa gccttgaaga gcccgtattt
92881    ctgtctatga aatctcctgt ttattgtact atgaggaccc atcagaaagt aactgaggta
92941    gtgctgattt cctgagcaat tattcagtcc actgtctcaa atccatcatg cagaatgttc
93001    acagagggta aagtaagttt gactattata actactcact tttataagtg atttaattta
93061    aagattaata tgataagtac tctgtttttc ctgggaattt tgttgtagaa agagtaactg
93121    ctgtgtggct aaactaaggt tataagccaa attgtttcct cagagtttaa gaaacacaat
93181    actaactctc atgggtttac tagttgtctg ttgctgcata acaaatcatt ccataatttt
93241    gtggtgtatt gctgcagaca atgttaaact aagtggatga aaaggatatt cacatagtct
93301    cagagtgtct ccctacaagg taggattact aacaaaggga aactaataat tatatagtaa
93361    ggaaatctcc ttaacccaat aatcaccagc aataagatgc agcaaccctc atcatgtacc
93421    tcttgatatg atgcactgac aaaagcacct ctcttctcta attttcttgc caaaatgcat
93481    aagctcaagc taattacagg aaaatataga caaacccaaa ttgagggaca ttctgcaaaa
93541    taactgaaca gtaattctcc aaaagtgtca aggtcataaa agacaaagac attgaggaac
93601    tgtcacagat tggagggaga ctaaggggac atgacaacta catgcaacct ggaatcatgg
93661    actgaatcct gggccagaga aggacattg ggggggaaac tggtgtaaag ggcataaagc
93721    ttgtagatta gttaacagta ttgcctcaat attaatttcc tgattttttt aagaactggg
93781    ctttggttac ataagatgcc aatatttggg gaagttgcat aaaaacatac gggaaatctt
93841    ttgacagttt tttgcagttt ttctgcaaat ctaaaattat ttcaaaacaa aaagtttaaa
93901    aatcaaatac acatagttgc ttgaaatagt aactatttta ttatattcca agatgttgtg
93961    agtcaggaat ttggccaaaa ctcaggtggg cgattcttct gcaaagaccc ccacaacaca
94021    ttcaaagtca caggcagagg ttgttggggg agggcattga aaagaagaga agagtcatag
94081    gtgggtgcaa tggagggagg gcagagggct gctgactatg gtgcaggact catccataat
94141    ggagccctgg ggaggcaagg gcttcataac tagacactgg tcttgtcacc tcagactcac
94201    ctgtagcagg accagatact gaggtcagac tgaaaacaca ggctctgcct caggagaggc
94261    tctctactag ctgagtaaat gatgacagta ttggaaatgt tcccaacatc ataatgggaa
94321    aacatcactt cacactacat aagcaataca caggggcagt gccggtcgtc ttcccaggtt
94381    agtagcagtt ctactgcctc caagagtgtt ggagaaatac aaaccaagca ttaggcactt
94441    ttaacttgaa aacatgaagt tctctttcct aactttcttt gtttccttat ttcttcttct
94501    tcttcttctc cttcttcttc ttcttcttct tcttcttctt cttcttcttc ttcttcttcc
94561    tcttcttctt cttcttcttc tttcttcttc ttctccttct cctttccttt cttctttttt
94621    tgctgagaca gggtctcact ctgacagtac agtggtgcca tcacagctca ctgcagcctc
94681    gacctccagg gctcaagcaa tcctcccagc tcaccctccc aaatggctga aactacaagc
94741    tcgcaccacc atacgtggct aattttttcta ttttttgtgtg cagatgaagt tttcctatgt
94801    tgcccaagtg gtctcaaact cctgggatca agtgatccat ccacctcaac ctcccaaaac
94861    gctgggatta caggtgtaag ccaccacacc cagcccacta acttttttat atcggctaat
94921    gaaatagttt taagtttaga ccctacgagg cataaagaaa taatttttagt tatgttatca
94981    gatgtacagt aatactcaag tgtgcaactg tggataactt gagttcatga ggttttttgtt
95041    tttttgtcaa aagaataaat ttatagtgaa actacccaaa aaagcaaagt acagaacagt
95101    atgctaccat ttgtgcacag aaatgggata tatatggtgt aactgcatcg aatttactgg
95161    atgtatgtcc agggaccaga actcttggtg gcttcatgtt catacttttg caagcacatg
95221    tgtagtatcc ttaacttaaa ggtactgttg tatacattct agtgttatca aaatttacat
95281    acatattatc aagtcagaga ggtcattctg tgtcttagta ttttcacttc atatttggta
95341    tatttatgta tgtatacaca catacctata tgtatttaaa taagatttat agtcacatgg
95401    tccaaaaatc aaaacaatgt ggaaggttt acagagaaaa gtctcaagcc taatcctgtt
95461    ctctactgcc aggtgaccat gttattaatt tcttttcata ccttgccaca gaattttcac
95521    ctgcaaacac agatattctt ttcttttta atgacagagt cacgttctgt tatccaggct
95581    ggagtgcagt ggcgtgatct tggctcactg caaactcctc ccgggttcaa gtgattctcc
95641    tgtctcagcc tcctgagtag ctgggattac aggcatgtgc caccacaccc agctaatttt
95701    tgtattttta gtacagatgg ggttttatca tattgaccag gctgatgtcg aactcctgac
95761    ctcaagtgat ccgcctgcct cggcctccca cagtgctggg attacaggcg tgagccacca
95821    cgcccagtca acacagacat tcttactcct tttttacaga gaatttatta ttattatttt
95881    ttacatagca ttttttctgca cctttctttt tccacttaac aatgcacttg aagatttttc
95941    catatttgta catcaggagc tttctctttc tttgttacca cattaaattc cactgggtag
96001    atgtaccata atttaactgg gtccttattg aaagacaatt gagctgtctc ctagacaaag
96061    ccttgtgcac cttcccKaac agagggtcta accaagcagg caggatgggg ttataaagta
96121    ggtggggagg tggagagac tccaccttcc caggtgggct gagaatggag gtaaggccct
96181    gcaacaggac agagggaaaa gtggggatga gaggtgggag gcgagatagc gcccactgtt
96241    ctcgctcagc cccctcctcc gtttgccgct gacctgttgg cctcccccaa cctctgagcc
96301    tgcctctgcc taggtaattt cccaagaccc agaaggggtg aagggtgagg tgtgattgcc
96361    cccacctcct tgcctcccgc agcatctgct ccgggaccat gaacaatagc tgacagctcc
96421    atggcccttg ctgtccccat ctcagcttcc ctgggcatct aaacctcagY tgccatgggg
96481    taggaggaca ggctgaggaa gcagaagcct gaggctgtct agagtctcac tcctgcatca
```

FIGURE 4-AA

```
96541    gcaggccacc acctgtggtt cctccttgtg caaatttgaa aagaattgca taaaacactg
96601    gagaaatcca agaggggaag tccacaaggg cggtggctcc ctacaaggtc acagagcaag
96661    ctggtgtcag agcctggacc tacagcgctg ttggtggagg tcctgcctcc aggtagggga
96721    agggctccct ctcacctcta cacgcagcgc atttcttggc tcagctgccc tgtagggat
96781    gcaggtgtgg gacagcagag atctgggcct gggagggaga gagtacacaa tcacatggct
96841    gttgccctg  tctcaggcct tgtctacctc tgactgtggc tctctggcag gaatagatgg
96901    acatggcctg gcagatgatg cagctgctgc ttctggcttt ggtgactgct gcggggagtg
96961    cccagcccag gagtgcgcgg gccaggacgg acctgctcaa tgtctgcatg aacgccaagc
97021    accacaagac acagcccagc cccgaggacg agctgtatgg ccaggtgagg gcagcctggt
97081    gtaggacagc atgcacacag gtcagagggt gatggcacga gcaatggcag gtccagtgtg
97141    gtcagaacca agggtgccgc tgctgacaag gaaggggagg ggcggccagg gccaccatgc
97201    cacaggtaag gccactgagg cagcttgggg aatatgagct ccaatttgaa ctccaggctc
97261    aggagtgtgc ttgtatttca ttcctctggt ctcctggcct gctccctaca aggtttcaca
97321    ttcccagagg gctggggatg tgcctaggga gagactgtgg cgtggacaca atctgtgggt
97381    taaagcgaag acaggacagc ctggaagccc catgacatct gagtcactcc caacattcca
97441    tttgcttatt tttaaatcgg ggttaaaaaa aaaaaacaaa tacataacat acattttcca
97501    ctttagccat ttttaactgt acggttcagt ggcattaggt atgctcatgt ggttgtgcaa
97561    ccatcaccac catccatctc ctgacctctt tcattctcca aaactgaaat ggaaactctg
97621    tgcccaccac ttcatttgct tttcagaacc ttctagagca catcctcctt gccaggaaat
97681    ggtgtggatg tagacctttg agagagacag atgactatca ttctcagggc catgagctat
97741    atgagagtga tgatatttgt tgagcccta  ctatagcaag ggagttcttc tcattgtact
97801    cagtaactct tttggaggca acaacccttg accctgacag gcaggaccca tgtctgccaa
97861    acccaagac  ccatgatgtg caaggggtct tgcaggaaga ccaagagttg gaacatccaa
97921    ggaaaagcaa gtgtgaagtc gggctggcag ggaagcatgt tctgtgtcag ccggcactgg
97981    gcgtgggcca gggtgtggga ggtgggtagg tctggctccc ctcccatgga tttccctatt
98041    gtttctcctg ggtgctcagg cctgtcacgc ctctgccatc acttgaccct aggtgcaagg
98101    gttcagccca gaaatKttat gcaattgatt catgatttct caggttttct gagtcctggc
98161    ctagagtgac ttcccaagaa aaaMctccac catttctgct tgtcttacct gccttgtatt
98221    tacctttcta ggattgcctt ttccacattt agtcaagtct aggttcagac ccacgtgcag
98281    gctatagctc cttcgttctc caccactctc aggatctatc tagagtctcc ccacctggac
98341    ctccagaccc tgggagagcc agaccagccc cttgacctcc accctccccc caaacctggg
98401    ccaggttcct ctcctccctg tcctcagtta taatttttt  ttttttttaat ttgaggcaga
98461    gtttcgctct tgttgcccag gctggaatgc aatggcatga tcttggctca ctgcaacctc
98521    tgcctcctgg gttcaagtga ttctcctgcc tctgcctcct gagtagctgg gattacaggc
98581    gcctaccact gtgcctggct aattttttgg tatttttagt agagacaggg tttctctgtg
98641    ttggtcaggc tggtctcgaa cttctaacct caggtgatcc gcccgcctcc ttaaatctta
98701    acctcactgt ttaccatggg tgtagcttac ttaaactctg taaaaatggg ggtaaggatt
98761    cgtactgggt tgttgagagg ataaagcgca aaagcctcag ggactttgca cctatggttt
98821    tctatgccta gagtgttctt tgtctccctt ctacacacag cccacccacc cactaaaacc
98881    ataccctccc tgagggtaga ggtgttattt gttttcttca ctgtggtgtt cctaggacct
98941    agcacagtgc ctgatgtata atcagcactc agttaatatt ggctggatgc aaaatgaata
99001    atataaataa gctgaataac atgaaatagg ccgaacgcgg tgactcacgc ctgtaatccc
99061    aacactttgg gaggccaagg agggtggatc acctgaggtc aggagttcga gaccagcctg
99121    gcaaacatgg tgaaccccg  tctctactaa aaatacaaaa ttagctgggc atggtggcac
99181    gtgcctgtaa tcccagctac ttgggaggct gaggcaggag aattgcttga acccgggagg
99241    tggaggttgc agtgagccaa gatcacgcca ctgcactcca gtctgggcaa caggagcgaa
99301    actctgtctc aaaaaaaagt tagtttaata acatgagatc acttttaaa  ccgttaagag
99361    ctgtactact aataattact ctctcagaca gtggctctcc ctcatctcct atatcccgtg
99421    gattaccctc tgttaaaagc caaaattaag caggcatggt ggctcacgcc tctaatctta
99481    gtattttggg aagctgacat gagccaagga gtttgagacc agcctaggca acatagtgag
99541    accccatctc tacaaaaata ctttatatta gccaggcatg gtggcatgtg cctgaattcc
99601    agctcctcgg gaggctgagg tggaggatt  atttgagccc aggatgttga ggctgcagtg
99661    agctatgatc acaccactgc gctccagcct ggtcaacaga gcaagaccct gtctcaaata
99721    aataaatgaa taaataggc  ggaaagcacc aatattgtaa ttgcctccgt ccccaggtgg
99781    gagctcctca agggccctcc caggaagtg  ttcctctgga tgacctacct ggggcagagg
99841    agccagaata tggaggagat ggctgtggtg gggagagact tagtcctgtg tcttccccac
99901    ccagtgcagt ccctggaaga agaatgcctg ctgcacggcc agcaccagcc aggagctgca
99961    caaggacacc tcccgcctgt acaactttaa ctgggatcac tgtggtaaga tggaacccac
100021   ctgcaagcgc cactttatcc aggacagctg tctctgagtg ctcacccaac ctggggccct
100081   ggatccggca ggtatgagtg ctgttccac  aaacattaac ctcagcagag ggcggagcct
100141   gccagttgct ggcagggagg gcttggtcca ggaattcggg tctgagggtg gtggacgccc
100201   tgcccctcc  cacagctctg gtccccttca agggtaaagc tgctgagata cgtggctgac
```

FIGURE 4-BB

```
100261    aggagtattc tgtctcctcc ccactcaggt caaccagagc tggcgcaaag agcgcattct
100321    gaacgtgccc ctgtgcaaag aggactgtga gcgctggtgg gaggactgtc gcacctccta
100381    cacctgcaaa agcaactggc acaaaggctg gaattggacc tcaggtgagg acctgaggag
100441    ataagatgag gagtgggagt ggggctttgg ggttggagg ggtgcggtct ggcccagaag
100501    ctaagggtct tacgttctcc tccctcaggg attaatgagt gtccggccgg ggccctctgc
100561    agcacctttg agtcctactt ccccactcca gccgcccttt gtgaaggcct ctggagccac
100621    tccttcaagg tcagcaacta tagtcgaggg agcggccgct gcatccagat gtggtttgac
100681    tcagcccagg gcaaccccaa tgaggaggtg gccaagttct atgctgcggc catgaatgct
100741    ggggcccgt ctcgtgggat tattgattcc tgatccaaga agggtcctct ggggttcttc
100801    caacaaccta ttctaataga caaatccaca tgtgtcttgt gtcttgtaat ttcgggacga
100861    gtgggttgga gggacacatt gcttcatctt ttccattgac aggccccaaa ttgggctgga
100921    actagcctaa tgttcactgg gaaggagggt gtggggttg agctagaatc caggtatctg
100981    atccgttagt ctgggtctct tacccctgca ctggcttccc cctcatgcca agctcatccc
101041    accggcacta cacatggaga aagacacaga cggagtgaag aagggcagag atagccgatg
101101    agttattggg cttcaagttg ggaagagagt ttctttagtg atgtgggctg ggtggagata
101161    ttggtgggga ggagggtctt gatgaacact tgccttgttt ccatttattt atttatttat
101221    ttatttattt atttatttat ttgcgacagg aatcttgata tattgcccag gctggtcttg
101281    aactcctgtg cccagacaat actccctcct tggcctccca gagtgctggg attataggca
101341    tgagtcactg tacctgacct gcttttttaaa aaaaaatgac aactaatgtt gcaattaaca
101401    atcttttact tagtggaatg ttatacttaa attccagaaa ggattattgg gtcaagagta
101461    catataattt tgagagttac aactttatgg gggttgtatc aatgtgcctc ccccaccagc
101521    aaagtatgag agtgcctctt tctccactgg gtgtgatggc tcatgtctgt gatcccagca
101581    gtttgggagg ctgaggcagg agaatctctt gagcccagga gttcaatatc agcctgggca
101641    acatggtgaa accccaactc tacaaaaaac taaaaaatca gctgggcatg gtggtgtgtg
101701    cctgtagtcc caactactag ggaggctgag gtgagagaat cgcttgactc ccagcaggct
101761    gcggttacag taagctatga tcatgccact gcactccagc ctgggcaaca gggcaagaca
101821    ttgtctcaaa aaaaaaaaa aaaaagaga gagagagaga gtgcctgttt ctccacaacc
101881    ttgtcaaccc actatgccat taaactttgg ttttctgctc atcttacagg tggggaaagg
101941    gcagctcagt gcagttttca tctgccattg ttctgagatc tttccatatt gaccattga
102001    tatgttaaat taccaggtag taatccattc taggtgtaca ttacattgaa ttcagtctcc
102061    tactgatggg cattggaagg aatggggttc ttttatgatc ctgacattgc tgaaagccac
102121    aggccagtta tttagtagaa tactcctcca tttgggtttg tctgtttcct catgattcat
102181    tgaggttatg cgttttgggc acaaataccc tacatggtta tcccgtgcat cataatggga
102241    ggcatgtggt gtggggtttg ctcattcctg gtgacgttaa cttttgatctt tttcttgaga
102301    ttgtgtctgc caggtttctc cactacactt tcccctttgt aactagcaaa tatgttgtag
102361    agagagactg gagaactaga gatactctat tcatcagcac acttccacct atatgttcta
102421    gtagctgatg gaccttaaac atgtcttact atgttacagc tctttcacca acccttcaat
102481    acttttcagt ggtatcaact gtaaaaacca aacttcttca caatagcaca gaagaccatg
102541    cccctccttt gagccctcaa gccaaatctc tcccacacca cccataaat gagctccagt
102601    cacatttctc atgttggggg tctttgctcc agcaactctt tctctgcatg cctgaaatgt
102661    tcttcattaa tcctctgcag cctagcactt tgtggccact tagatcacaa cctacaatcc
102721    cccctaaaa tgacttctga ccactcaaac tgacaaaccc accagctga tttctcatca
102781    cactactcta tgtccttgtg cagatttta tctactgtgt ttgttgtcag ccttttccct
102841    aacaaaacat actctcccga aagcagggtt gtgtctgtgt cattatgc tacatcccca
102901    gggtctgggt cagtgcctgg caccgagaat gtgctcagta agttaaggaa tcgctgcatc
102961    cattctgtca gtcaacaatt ccttctgagc atccagtcca ctggcccatg ctggtctcag
103021    ccaacagaaa gggaattgag ttccttgcaa ggtctggtgg ggacagacag ttctgagaac
103081    cagtgactct tagaacaagg agatgaggct ttcacagagg gaagcacaga gtgtggtatt
103141    attctgctga agcccaaaga ggtcagggaa ggattccaaa ggagtaatgt ttgccaagca
103201    caaaacagca cagggaatgg cattccatgg acaggtctca gcaagtgcaa aggcttagag
103261    gtaatagaag tgcaagcaga attccagggt ggctaagaga ggttgtgtgg ggaatgggca
103321    gcagttaagg ccaaagaaga aacactggat ctgcattcct taggacggtg ccctgtgggc
103381    ccctcacaga gcttctctcc tgcaactgct aggtataaga aggcaggctt agaatcggac
103441    tgagatcagt agtttctgca gctgggaaga tgagtgaggt gagattgcat gtgtgatagg
103501    ctggcactca gggaagacct cagggttctc tcctccccac tctgaggccc ctctcctgct
103561    tcctgaagcc cagagtctcc acctctgtga gccaaacacc ttcctgttat ctgcctggtc
103621    ctagggtagc cttcggttg gggttagaag gaatgccaat ggttaacctt gtggtattaa
103681    gcttccagct caggcagata ctctctggac tggttcaagc tgactgcctg actgtccctc
103741    cctgctggcc ctagcaccca gactccagat aggcacacca cctcacccttt cagagcaggg
103801    ctctgagact ccacaagtgg tgaggactta ccagaggaac tgaacttgac ctccaaccca
103861    accttccatt tgctggtatt attctgaagc cctcatggcc caggggcctg cctcaggtag
103921    caggtctcac tcctgcagtg gaggggccat aaagttcagt tcatgatcag cccccaagcc
```

FIGURE 4-CC

```
103981    aggggcagcg gatgacaggg caggagttcc atctagagga gctcctgtgt tcaggcgttc
104041    ctagacacct gcctgccctt ctcccatcag cactgggta taaagaagga aagaggcctg
104101    aggtttccag aggcctctac ctgctgaggt cttaagagga ctcaaccctc tgggaaatac
104161    aaataaaatc ctcaaccctc caaacaactg aatggacacc tcttggccaa agagaccccg
104221    gaaaacttt aaaatccaag tttcctggcc gtgatgatag gtcactcaca cctcagcaca
104281    cctgcttcct cacgaaccgt taccaggctt cttcccaag agctaaacag aaaccagccc
104341    tgaaaaccaa gaacaggaga ctccttcact gatttcaatt tcaaccaatt ccgagactcc
104401    cttcccttc ctgattttga catgacagct gatcagctta caaaacattc ctggctgatc
104461    aatgactctc aaccatggac cagttctggc tggtttacag aggcagcaca caaagtgctt
104521    tgggtcctgt gtttcacatt ttgacataca gagcctaatt caactgcatt ttaatgtctc
104581    caccccgaag tgaatatggg acatatttaa catgttttat tggtacacat gtgtgcaact
104641    ctcatgaata ttcataaatc ctcttaaaac ttattaaata tatatgttta gccaactgat
104701    ttagtgtaaa accccctgtcc cttcaattcc tagcttgtag gttgcaaccc atcaaaagaa
104761    ataaagctct ctttccaaa tgtaaagatc ttatgatttt aagccaatat aattgaagac
104821    aagagtagga tccatggagc agcccaggtt cccccagcct aagtgaatgc acaggtgcca
104881    ggtggagcca ttgacagctc atttgtctcc ctgacagctt ggggaggaag gtgggtaagc
104941    tctccccgat ctaagatctc tcactttga attgagatct cgaggacttc attttttac
105001    cctgatcccc tccatccgga ccctgcaagt gccatctttg ttggtcccag gtttctagat
105061    ggggaggttg ggggcagtta agcctgactc atccggcgca tcagcccatc aggtttggtg
105121    aggatgcttg ccctctagtg gcacacgaag gaatgtctta tgcttttctg gggaatctag
105181    attctaagga gacagtccca gaccagctgc catcaggaac atgcatgttt cagaattatg
105241    agaaaaagtc ttgtgaatat tttggatcct ggaaaaaagc taacctggaa caatataaag
105301    atttataggc caaaatggag aacttttggc agaatgtctg acatgcctaa attagtttat
105361    ttgcatgcac aatagggttc aggacctctc agaagcaatg ggaggtcttt tttttttttt
105421    tttttttgag acagagtctc actctgtcat ggggagtgga gtggagtggc acgaacatgg
105481    ctcactgcag cctcgacctc ccaggctcaa tcatcctccc acctctgcct ctcaagtagc
105541    tgggattata ggcatgcacc accacacccc actaatttct ttatttttcaa ttttttaattt
105601    tttatagacc atgctggtct caaattcctg gactcaagga atcctcccac gggagaccat
105661    ttttcagtgt tattatgaga gctctaaaca cagttgggag tctcagataa cctccttaaa
105721    tgagactaat tcaaaactga aggagtctaa ttcaaaactt gaccagcata ttcaaaccta
105781    tctgccacta ttggacaggt agctgaagac actgcaaaaa gccttatagc ccaacaaatt
105841    gaattccctg gctcaagtag taatagataa tttaattgct tcagattttc ttttacccaa
105901    acaaggaaga gtctgtgcag tggcccaataa cacctgttgc acttacatca acacttcagg
105961    tgaagtagaa actcatatag ggttgggcac agtggctcac acctataatc ccagcacttt
106021    gggaggctgg ggagggagga ttgcttgagc tcaggagttt gagaccagcc tgagcaacat
106081    ggtgaaaccc tatctctaca aaaactgcaa aaattaacca ggcatggtgg cacatgcctg
106141    taatcccagc tatttgggag gctgaggcaa gaggatcact tgggcctggg aggcataggt
106201    tgcagttagc ctagatcacg caattgcatt ccaaactgat aaagcaagac tctgtctcaa
106261    aaaaaaaaaa agaagaaaaa ctcatacaga aagaatttcc aaacaagcta aatgattaca
106321    agaaataaaa ctactgatcc tatcaatgat ctgttcagtt ggctttctac caaacagaaa
106381    ttcctttcaa gatgctattg aaggctgggc gtggcggctc atgcctgtaa tcccaacact
106441    ctgggaggct gaggcgggtg gatcatctga ggtcaggagt ttgtgaccag cttggccaac
106501    atggtgaaac cccgtctcta ctgaaaaata caaaaaatta gctggtgtg gtggcgacac
106561    ctgtaatccc agctacttgg gaggctgagg caggagaatc gcttgaacct gctaggcgga
106621    gattgcagtg aaccgagatc acgccactgc actccagcct gggtgagagt gagactccat
106681    ctcaaaaaaa aaaaaaaaaa aaaaggtgc tattgaagtt tttgttataa ttatagtctc
106741    catcaaactt ttcttcataa catttaaatt acttataata tgggacaggc atggggctc
106801    aagcctgtaa tcccagcact ttgggaggtg ggcagatcat ttgaggtcag gagttcaaga
106861    ccagcttggc caacatggcg aaacactgtc tttactaaaa atacaaaaat tagccgggca
106921    tggtggcatg tgcctgtaat cctagctact cgggaggctg aggcaggaga attgcttgaa
106981    cctgggaggc ggaggttgca gtgagccgag atcacaccac tgcactccag cctcggcaac
107041    agagggatac tctatctaaa aagtaaatat aaataaataa ataacttata atatgtataa
107101    ccaactgctg taagtctgct gctaaaacca gaattatgct ggctcaatgc atagaactta
107161    tagacaagtt aaattggtag ccctaccttt tggcctttat attgcttgat agaccttagg
107221    ggttgatgag tacctgccca cctctatttc tgtctggcca agatgttcaa ttggctgtaa
107281    gtctcttggc cacaagggtc ccaccaaggg actggatgga tctggagcag gtagcctcag
107341    catcctggca acgacatggt acaaacaatt tggccattga tgctgactgt ggcagatctt
107401    ggctaaaagg aagaaatgtg gaataaaaag aaaatccaaa gacccctcaa ctgactgaac
107461    aaaccctct tggccaagga gaccccagaa aaactttaaa atctaggttt cctggctatg
107521    ataagacagg aggctggtca cacctcagta tacccctcttc cttactgtta ccaggctttt
107581    ttcctaagag ttaagcagaa tcctgtcctg gaaaacagag aatggaagac tcctccgctg
107641    acttcagctt caactgcctg atgccatggc cagacttcac tctcttttg tgatttgaca
```

FIGURE 4-DD

```
107701   cgacagctga ccagctcaca aagctatcct tcctgatcag ttcctgttaa ccatgggctg
107761   gttctggctg gtttacagag gctgcacaca aagtgccttt gtgtcctatg tttcaccttt
107821   tgatgtgtat ggcctaagtc tgcattttaa tgttaagtct cagctgggta tggtggctca
107881   atgcctgcaa tcctagcact ttgggaggcc aaggcaagag gattgcttga gcctaggagt
107941   tcaagaccag cctaggcaac atggtgagac cttgtctcta tttttttaat taaaaacaaa
108001   atacaaatat aaaaataatt actgttaact ctccacccca aagtgaacac aggatgtatg
108061   taacatgtat gtttgcttag tatacatgca tgtgactccc tttcatgaat attcatagct
108121   cctcctataa cttattaata agtatactag ctaacctatt tagcataaaa ctcctgtccc
108181   acctctcctc cctcaaagtg cctgctttcc atctcagcca gaggctccac ttcccagcct
108241   gcaggttaca acacaatatt agtaaaagtg ttctttccaa gtgtatacat ctggtgattt
108301   taagttgata cttcccaggt tgtccaagat tcaggtacag ctcactattg caggatacaa
108361   gctgggatct cctgggagtt ggtctctttg caaatcgtat tatctctgta tcaccttta
108421   tgaaatccta aaagaattta aatctgaaac atgtgactcc aaagattttg aataaggaat
108481   tgtgaaccca tggtaaactc ctggcttaag ggtgtccaat ttttggctt ccctgggtca
108541   cattggaaga ataagaaagt ttaagaaagt ctgtgaattt gttttggggc acattcaaag
108601   ctgtcctggc cacatgaggc ctgagggcta taggttggac aagcttctag ctggctattt
108661   ctgcattttg tccaaatcca tctttaatt attatcatta ttattattat tatttgagac
108721   ggagtctcgc tctgtcaccc aggctggagt gcagtggcgc gatctcagct cactgcaagc
108781   tctccctccc gggttcacgc cattctcctg cctcagcctc ccgagtagct gggactacag
108841   gcgcctgcca ccacgcccgc ctaattattt tgtatttta gtagagaagg ggtttcaccg
108901   tgttagccag gatggtcttg gtctcctgac ctcgtgatct gcccacctcg gcctcccaaa
108961   gtgctgggat tacaggtgtg agccaccgcg tccagctgaa acataatttt tctcttttg
109021   gtttcacatt tttactaaag acaaatcatg gtaagactga tttgctttat tatacttggc
109081   ctgattattt gtgtaacgtg cagcaagaat acttacttt cacataggct ttttaagttg
109141   gctttgatgg aactttgttt tgtagaagaa tctcagatta gactttttct tttaaggccg
109201   ggctcagggg ctcactcctg taatcccagc actttgggag gctgaggagg gaagatcaca
109261   tcaggagttc aagaccagcc tggccaacat ggtaaaaccc cgtctctact aaaaaacacc
109321   aaaaactagc caggcatggt ggcaggtgcc tgtaatccca gctacttggg aggctgaggc
109381   aggagaatca cttgaacctt agaggcaaag gttgcagtga gccaagatca caccattgca
109441   ctccagcctg ggcgacagag cgagactctg tctcaaaaaa acaaaacaaa acaaaacaaa
109501   actttttttt taaagccgag tttggccatg cggttgtacc atcaaatacc tatgagttgg
109561   gtgaattcct cttgagaacc caagatgatt tggggctcct gggtctgtca gagagtgaca
109621   ttctttactt gccacaggtc agaaaccctg ctcaggatct gtgtagaaaa ggtatgaagt
109681   tagtttttccc aagggctct tatcagctct ataagtcaag tttgattcct taaaggaaag
109741   cacaccattc cagtcaaagc cttggtaaaa taactggttt ctccaattgt gtcctgttac
109801   aaaagaaaac agattctggc tgggcacagt ggtcatgcct gtaatctcag tactttggga
109861   ggctgaggtg ggcagatcac ttgaggtcag gagattgaga ccaacctggc caacacggtg
109921   aaaccccgtc tctactaaaa atacaaaaat tagctgcttg tgttgtgtaa ttgggtaata
109981   agagatttta aagaattttt tttgtagagc accatggttt aaagtcagct taattaaaat
110041   tagatattca agctctaaca gcctgggact ccttggggaa aacaggaggc gccagagaca
110101   ccattttgga aaaaaccct gttttcctct tggaacccca ggaattgaaa gctgataaat
110161   tcctctcaaa atttaaggct tgttctgtt ttggattgca gtatctgaag tttttgactt
110221   ttggtctatc agaaattata tcgcattatg agagagtttt ggtgtgtaat aactaggtag
110281   gaaatatact ttaaggaatg gctaatggaa attatagatg atcacgtagc tctttgcatg
110341   tttggattag agaagcatgc tcttggccac ctggaaggta tggaaatacc ttttttttt
110401   tttttttttt ttttgagaca gagtctcact ctgtcacccc ggctggagtg cagtggcaaa
110461   atctcagctc actgcaatct ctgcctcctg ggttcaaagg attctcctgc ctcagcctcc
110521   caagtagctg ggattacagg cacctgccca catgcccagc taatttttgt attttttagta
110581   gagacgggt ttcaccatgt tggccaggct ggttttgaac tcctgacctc aggtgatctg
110641   cctgcctcgg cctcccaaag tgctgggatt ataggtgtga gccaccgtga ctggctggaa
110701   atatcttctt atctcccact gagagataag acttccacag aagatgggct gattcccct
110761   tttttgggga gggatccagg gtctggtata aatgggatc ttcatttgg gggatctgtt
110821   ttgccttcca gctgtgcctg cttattaggg ccaaaggtac tgggagtcc cagctatttg
110881   ggagactcag gcaggagaat cacttgaatc caggagatag aggttacagt gagctgagat
110941   cacaccactg cattccagcc tgggtgacag agttagactc tgcctcaaaa aaaaaaaaa
111001   aaaaaaaaa gaaagaaaga aaaagagac agattattta gattatttat ttacttactt
111061   ttttttgag atgcagtttt gctcttgtca cccaggctgg agtgcaatgg cacgatctcg
111121   gctcactgca acctctgcct cccgggttca agtgattctc ctgcctcagc ctcctgagta
111181   gctgagatta caggcacaca ccaccacacc cagctaattt ttatttattt attttttagta
111241   gagacagggt tttgccatgt tggccaggct ggtcttgaac tcctgtcctc aggtgatcca
111301   cccacctcag cctcccaaag tgtgggatt acaggcgtga gccactgcgc ccggccaaga
111361   aacagattct tattgcactt atgcaaataa ctatattgct ataagttaag aatactcaca
```

FIGURE 4-EE

```
111421   cctagtttcc taattctgga aaaatcaggt agaaaaaaac aaatatgctc caaatatgtt
111481   gccagaagta tactttactg aattgttttt tttttttttt ttgagacgga gtctcgctct
111541   gtcgcccagg ccggactgcg gactgcagtg gcgcaatctc ggctcactgc aagctccgct
111601   tcccgggttc acgccattct cctgcctcag cctcccgagt agctgggact acaggcgccc
111661   gccaccgctc ccggctaatt ttttgtattt ttagtagaga cggggtttca ccttgttagc
111721   caggatggtc tcgatctcct gacctcatga tccacccgcc tcggcctccc aaagtgctgg
111781   gattacaggc gtgagccacc gcgcccggcc tactgaattg ttaaaaggtg taaatagctc
111841   aaaattttc ctgactctga aaacaaaaca aagtttcagc agcattttaa gcaaagtcaa
111901   aaacatttct tcagtcttct atttgttcat tccatgcagt taactcctgt cctgtttaat
111961   cgtcatgaac atttcagctg tccatgagtc ctgaaagttt ttcctctatt ctgacgtcac
112021   aatctccaaa cttatcagaa acctgcattc aagagaacct gtcaaaatcc tatagttgat
112081   tataaaccac cttttgaaga ggatcaaaat aagaaaacaa ttgtctgtgg ttgacagaag
112141   tcttaggaca gccactattt aagccacaat tgaaaggaa atgtgggggt gggcacggtg
112201   gctcacgcct gtaatcccag cactttggga ggccgaggca ggcagatcac ctgaggtcag
112261   ggatttgata ccaacctggc caacatggtg aaaatccgtc tctactaaaa atacaaaaat
112321   tagctgggga tggtggtggg tgcctgcaat cccagctact gagagtctga ggcaggagaa
112381   tcgcttgaac ctgggaggtg gagttttcag tgagctgaaa ttgtgccact gtactacagc
112441   ctgggtgaca gagtgagact ctgtctcaaa aaataaaaaa gaaagaaaa ggaaattttg
112501   gttagttctg tgacaacaaa tttacataac aattatgact attaataaca tacactaagt
112561   tatcaaggaa ttatgggtgt tttccataat tttggaacat gtccaataac atatttatgc
112621   aaatataggc caaagaaagc caaatactat ttcacatttg acgatgcttc ctttatggat
112681   tttatactga ataagccaaa tttcaccttt acgttagtgt actattaatg ttaaacccaa
112741   ttctttaata aaacctttta gacaaattta tttaatctta atcagtttga ccataaagta
112801   agattcttat aaacttttgt ttcctcacct ccccagaaaa gtggatccta aacctttat
112861   aacccttttac aatttttgtg aacgagcaga ttaatgctct aagaaaacc tgttgtgctt
112921   ttattccaat gtttgattta tagaaaaaat gaatacccct ttaactttag ccaacatgtt
112981   cacacagaat ttcttttatg acattaattt ttcacaaacc tcccacaatt tgttcaagcc
113041   ttcagcttta tctcatctaa acaatcctt taacccttta atctaggcag aaaaatccac
113101   attcccatga cttcttataa tctttaccaa aaaacacatt tcactttcct tacacacctt
113161   gcatgtaaaa ctgatgttat ttcccaaaga ttactaaagg catataaact aaaaggcatc
113221   acagttttta ttttctaat aaaatatttg atttaagctc ttattatttt taacctatt
113281   aatcaaagct cttttatatc tcacacacac aacatatata aatacacaga ccagaagatc
113341   cagtagttga aagaattttc atttgccagt ttcttttcct ttctttttt ttgaatcgga
113401   gtcttgctct gtcgcccagg ctggagtgag gtggcttgat ctcggctcac tgcaagctcc
113461   gcctcccagg ttcacgccat tctcctggct cagcctcctg agcagctggg actacaggct
113521   tctgccacca cgcctggcta agttttgta cttttagtgg agacggggtt tcactgtgtt
113581   agccaggatg gtctcgatct cctgacttcg ttatccacct gcctcggcct cccaaaatgc
113641   tgggattaca ggtgtgagcc accgcgcccg gccatcattt gccagtttct taattggatt
113701   actgacttta gggtggagcc cttggggaa caaggtcagg aaagcatgca gtttctacag
113761   cctaataagc aggcaagctg gaaggcaaga cagatccccc aaaataaggg tcccattta
113821   taccagatcc tggatccccc ccaccaaaaa agggaaatc agcccatctt ccgtggaagt
113881   cttatctctc agtgggagat aagcgggtat ttccatacct tcgaagtggc caagagcatg
113941   cttctctaat ctaaatatgc aaagagttaa gtattcacca ataacttcca ctggccattc
114001   cttaaagtat atttcctacc tagttactac acaccaaagc tctgtcataa tacgatgtaa
114061   tttctgatac caccaaaagt caaaaacatc agatactgca atgcaaaaca gaacagagcc
114121   ttacattttg agaggaattt gtcaacttca aactcctggg gtttcaagag gaaaacagag
114181   tggtatttt ttttttttc caaaatggtg tctctggcac ctcctgtttt tcccaggag
114241   tcataggctg ttagagtttg aatatcctgc tttaatgaag ctgactttta accatagcac
114301   tcttaaaaat aaaaatcctt taatgtctct tattacccaa cttcagccat gccaaactac
114361   caatatttct ggcttctgaa ctttaccaaa ggcaaactcc caggtactcg gagaaaaaaa
114421   attcaagaca gtttgtggag ggaaagagaa tctacaaatg ttcagacaga tctcaaacta
114481   gaaaggactc attccctaag ctggggattg aaccctgaac ctgggctgcc actgtgaaaa
114541   gacagtctta gctgctgagc tacagcattg ggcagtctcc attgcccttc ccagaaggag
114601   gctagagtca ccaattttga gcttgcaaag gcttttatct gatcaagata attttagga
114661   gtaactatgg catgaacccc aaaactcctg tctgctggat ggtagaaacg aagagaaagt
114721   atcgccacgt ggttacaagg tgaagctccc aaggacataa acaagacga aagagaaatt
114781   tcatccagct tttcagggac cttcagcaaa gtttataact gatcagtttg cttggccatt
114841   ttgaacagcg ggcttacagg cgtcatagtg agagacagga ctagctggat atcctaggcc
114901   tactaagaat cccttaagcct agctgggaag gtgactgcat ccacctttaa acacggggct
114961   tgcaacttag ctcacacccg accaatcagg tagtaaagag agctcactaa aacgctaatt
115021   aggcaaaaac aggaggtaaa gaaatagcca atcatctatc gcctgagagc acactgggag
115081   ggacaatgat aggatataaa cccaggcatt caaaccagca agggctaccc tctttgagtc
```

FIGURE 4-FF

```
115141    ccctcccttt gtatgggagc tctgttttca ctctattaaa tcttgcaact gcacactctt
115201    ctggtcagtg tttgttacga ctcgagctga gctttcactt gccgtccacc actgctgttt
115261    gccgccatcg cagacccgcc gctgacttcc accoctccag atctggcagg gtgtctgctg
115321    tgctcctgat ccagtgaggc acccattgcc gctctggatt gggctaaagt cttgtcattg
115381    ttcctgcacg gctaagtgcc cgggttcatt ctaatcgagc tgaacattag tcgctgggtt
115441    ccacagttct cttctgtgac ccacggcttc taatagagct ataacagtca ctgcatggcc
115501    caagattcca ttccttggaa tctgtgaggc caagaacccc aggtcagaga acaagaggct
115561    tgccgccatc ttggaagcgg cctgccacta tcttgggaac tctgggagca aggacccct
115621    ggtaacagta ggcttgcatt ctatcctaag gtacccttct ttatggcaga acaatataga
115681    cacacaaagc acaccagatt cgttacagct taaggctagc ctcacaagtc ttttttctca
115741    ttaaccaaaa cttgcctgtg gtaaggtggg gaaagtgaag agctcaggaa gaccagagaa
115801    agactcacct atcccagtga cactgaatca aaagttcagg cagccgctca ttggttaaga
115861    agggatcttt tccaggagtt gcatcagctc ttaagtgtcc ccgtttgggg agcaaaaagc
115921    tctcatgtcc caggatcctg tacatacaca attctgtcac ccacagccat cagcaaagat
115981    ttcaaggtag attaatccaa agagaatagc aattaatatc ccatggtgct aaatccgttc
116041    ttagccaaga ggaactttac tctgagaggg gcttctaact ccctaaatct tagaagggac
116101    tctaacactc ctgagttggg cctcaaacca aagttcagtc aagtgtcctt gccttttatt
116161    aagaggggcc tttaacccac tctgtcttag gagagacttt aactcccta agttgagcct
116221    ctaacccaat tccatccttt acctgggtac cccgccactt accctagata gccaattggt
116281    gctgcagtct atttcctttg ggtagggtgt ctcctcaggg ttcgacagga agatgttacc
116341    agaaagggat ccagatccag accccaagag aaggttcttg gatcttgtat aagaaagaat
116401    ttggggtgag tccatagagt aaagtgaaag caagcttatt aaggaggtaa aggaatacag
116461    aatggctact ccataggcag ggcagtggct tgagctgctc cactaaggat acttattgtt
116521    acttcttgat tatatgctaa agaaggggtg gattattaat gagttttcca aggaagggt
116581    ggccaattcc cgtaactgag ggttcctctc cttttagac catttagggt aacttcctga
116641    tgttgccatg gcatctgtaa tcacggcact ggtgggagtg tcttttagca tgctaataca
116701    ttataattag catataatga gtgatgagga tgaccagagg tcactttggt cgccatcttg
116761    gttttggtgg gtttgggctg gcttctttac cacaggctgt tttatcagca aggtctttgt
116821    gacctgttat cttgtgctca cctcctagct catcctgtca cttggaatgc cacacctcct
116881    gggaatgcag cccagtaggc ttcagcttca ttttacccag cccctattca agatggggtt
116941    gctttggttg aaacgcctct gacagaccca ccagaggagc ccttcagttt gtattaatat
117001    gatatgtgac tacttatttc acagacactg tgtgtcaaat gtcggtacaa tgccaacaac
117061    tcactttctt ggttgttgag tttccgcatt acacaaataa ggaagcaggc ccagaggaga
117121    gcctgggaaa tgaagttgga gagacccatc ctggggttgc ttgatttagg gatttagact
117181    gggaatgact cctccataga tctgaaagaa gaaactgcac actgttcata gtggcttctt
117241    ttctgccagc cctaaacagc tcaagaaagg agagtctctc agttatgagg ctgggtgtga
117301    agcattttt ttttctttga gagaggtctt gttatgttgc ccaggctggt ctccaaatcc
117361    tgggctcaag cgatccttcc accttggcct cccaaagtgc tgggattaca aatgtgagcc
117421    accacatccg gcctgaagca tcttggttca tgcatctagc aaaccttcag tctgtgtctc
117481    tcaatcccac tggacatgag gtctgcctat aacaattatt tggctacaac ccctttaata
117541    tcctgaactt agctaaacag ttattttaaa aatccatatt caaatataac taagaagaa
117601    acagaggaaa agtaatttgt aatatggatt tctatttata ttcgttttga ctccattagc
117661    agatagcagt cactgccctg tttgcacttg ttttgaatca gtgagcctgt agctgccaag
117721    tgcagactaa caagaggtaa ataacctgta taccttgagc agctctgact ttaacttatt
117781    cttttatttt ttatatttt attttttatt attttttatct cttttttagac atgaggtctc
117841    actatgttgt cccagttgac ctcaaactcc tgcactcaag tgatcctccc accttggcct
117901    ccaaagtact gggattatag gtgtaaacca ctgtgcctgg gcttttatat attttttaag
117961    tgcacatttt aatgtttagc ttgtcagcct taagtaacga gatccagaaa gcttgaggat
118021    agctacacag aagcatagat tcaagttgtc ctgaatatac acttcgattc acagcagtta
118081    caagtgagtt tttaaggaaa cagaatagtt cctaagttgt ttatcaagaa tttaaaataa
118141    aataacataa gcaattcatt ggctatacat tgttttttgt atcacaaatt ccaggaacag
118201    ataacgggtg aggcagctag tcagggacaa aacgccttgg aacaattgtc tctgggcatg
118261    ggtggggagg gtgtgactga agttccatac tcatgccttt ctgggcctga taaattgggc
118321    atgtctcaca tcatgagact gctctgagct attttctttt tctcaagctt tataccaaat
118381    tctaggccgt gggctttcat tcattcaata agtatgtatt gagtgtttat gtaatcggaa
118441    ctcttctggg gttacaattt aacttacttt ctcacctccg aatggttatc acctcaacga
118501    ggactaaatc caatgatttt tttttatctt gccaaaattc ctatctaagg ggtctgggga
118561    gtcatgccct acaaatcata aattctcatc agatgggttt tatttaaccc tatatatcat
118621    gacttacttt ccaacctgac tctggcataa catgacgaga caaggaagaa aagcaaaata
118681    ttttaatatt tttacctcca aacatgtttc tttgccatat cttgaaatgg ccctgctact
118741    gtcctttgtg ggggaaaatt ttcatctgta aagaatctct attaacatag ctggatcttt
118801    ttctaccagg cccttccaat cataaagaga ttaactaagt gtagcacctt ttatagatct
```

FIGURE 4-GG

```
118861    gaataggaaa cacttgtcat ctgttgtttc taagggcagc cactataaga cttcaaaaga
118921    accttggtct ccacagtctt ttatcttaac atttcttttc tatcaacccc aggtctttag
118981    acaaactcaa ccaattgtca accataaaat gtttaaattt acgtatagcc tgaaagccct
119041    gccaccccac tttgaattgt cccaccttcc tggaccaaac caatgatttt ttttttttt
119101    tttagatgga gtctccctct gccgccgtg ctggagtgca gtggtgtgat ctcggctcgc
119161    tgcaacctcc gcctcctggg ttgaagcaat tctcctacct cagcctcctg agtagctagg
119221    attacaggtg cctgtcacca cgtccagcta attttttgta tttttagtag agacagggtt
119281    tcactatgtt ggccaggctg gtctcaaact cctgacctca agatcagcct gccttggcct
119341    cccaaagtgc tgggattaca ggcgtgagcc accgtgcctg gccaatgtat tccttaaatg
119401    catttgattg atgtctcatg cttccctaaa atgtatgaga catccttctc ccctgattgt
119461    tttcaaaagc agtgatccat tgaggtgctc attttgtaa ccccagttac tagaaaagtg
119521    cctgggtaag agtatgtagg atctctataa aagctgaatt aacgaatttt gtaatgactg
119581    cacctccaga caggagctgt cttccgggct tccacagtct ctgacagccc tctcccacaa
119641    agagtttacc aacagcaagg actttcctgg atgacttcca ctgggttggg gattaaggat
119701    tgaaggggga gaggctgggt gtggaatatt ctggctgtgc tggctgtgga cttagtcctg
119761    tgtcttcccg catccagtgt agtctctgga gaaagaatgc ctgagcttta ccagcaccac
119821    ccaggaagcc cataagaata ttcccatcta tatggattca actggaacca ctgtggagag
119881    atggtacctg cctgcaaacg gcactttatc caggacacct gccttacga gtgaccccc
119941    aacttggggc cctggatcca gcaggtacgc atggcttcct ggcatccaag agctagcaga
120001    ggagctgaat tttccaggcg tctctgcagg cagcaacccc agctccagtt ctattcaggg
120061    ctgggttcct gggattcttg agcctgagcc cttcttttct accaaaatct cccaggtgga
120121    tcagagctgg cgcaaagagt gggtgctgaa tgtgcccctg tgcaaagagg actgtgagca
120181    atggtgggaa gattgtcgca cctcctacac ctgcaagagc aatgggcaca agggctggaa
120241    ctggacctca ggtgagggct ggggtgggca ggaaggagg gatttggaag tgaaggtgtg
120301    tgggtgtgga acaggtgtgt gacattttgg ggttgtaggg ctggcagaat cagagaccct
120361    ttggggccca gtggctaaag gtcttccctc ttccctacag ggtctaacaa gtgccaggtg
120421    gcagctgcct gactacctt ccatctctac tttctcacac ccactgctct gtgcagtgaa
120481    atctggactc actcctacag ggtcagcaac tacaaccgag ggagcagccg ctgcatccag
120541    atgtggttcg acctggccca gggcaaccc aatgaggagg tggcaaggtt ctatgctgca
120601    gctctgagtg gggctgggcc ctgggcagcc tggcctctcc tgctcaacct ggccctaatg
120661    ctgctgtggc tgctcagctg acctcctttt accttctgat acttggacat ccctgccctg
120721    tttagcccca cagctcccaa ctatttggtt cctcttctat ggtcttgtct ctgacagcca
120781    cttttgaataa accagcacc acacatgtat cttgagaatt atttgggtat gaatgggaat
120841    gtggctgttt tgtttcccat ttcttattga ttgaagccag ttagactggg ctagttccca
120901    gctctgatgc ttgctatgaa ctagcctgat acttaagtat tcttctaagg taggagacat
120961    ttgtagctct cgatttatt attcactata gctccaattt agagccaagc ccaggcattt
121021    ttcttttttt gagacagggt ctcactctct cacccaggtt ggaatggagt ggcatgatct
121081    cagctcactg caacgtctgc ctcgtgggct caagtgatcc tcccacctca gcatcccaaa
121141    tacttgggac tacaagcatg tgccaccaca cctggctaat ttttcaattt tttgtagaga
121201    ggaaatcttg caatgttgtc caggctggtc tcaaactact gggctcaagc aatcctccta
121261    cctcagcctc ctgagtagct gggtctacag gtgtgagcct ccacattcag ctaatacata
121321    taatataaaa catgtattat atatgtaata gtagagacag ggtctcacta ttttacccag
121381    gttgttctca aactcctgcg ctggagtgat cctcccaaaa tgctgggatt acaggcatga
121441    gtcactgcat ctggccacaa gtcatgttta ttcttgctc aagctacaat gctgaatgtg
121501    ggttatcagg gggattctgt ttatttctca ttcctggact acattagcag ccaggggtt
121561    ctgcttctca ctcaagaacc cacgctgatg gaggctccat cttccatgag acaggaagag
121621    ggaacttggc aaattccata aggctcttca aatttccacc catcacttat ttcattggcc
121681    aaatcaagtc atgacgatgc ctaaattcaa gaaagccagg aaaacataat cctatcatgt
121741    acttgcaagg agaggggaat cacaaggttt gcaacagacc taatcatgag taaaaagact
121801    tcattatttt ctcgtagatt tctgtttctg gcatggtcat agttacaaat ttaattttt
121861    ggttagatcc tagtaagaag gaggaccaac tctctataca tatgcaaata actacatcaa
121921    cctgaaaagt ggagcaatcc actgatgacc gccctggcta gtcttgtaaa caaggccaat
121981    tgatgccttt tcgcccttca tttatttcta tttattattt ttattttttg agacagggtc
122041    tctttctgtt gctcaggctg gagtgcagtg gcacagtcat ggctcactgc agtcttgacc
122101    tcctgagctc aattgatccc tcaactttag cctcccaagt agctgggact acaggcacat
122161    gccaccatgc tgggcaaatg ttttgtattt ttttgtaga gatggggttt tgccatgttg
122221    cccaagctgg tcttgaactg ctgcgcccaa gtgattcatt cacccacctt gacctcctaa
122281    agtgctggga ttagaggcgt gagacacctc tgccagccca ctgatttctt ttttgaaccg
122341    aaagcatagt tgatcaatgc aaaagctaat aattggatat taacaaaatt caaaactctt
122401    gcactttaaa agacacccct aagaaaatta aaaaacaagc aacagactgg aaggaaatat
122461    ttgcaaacac atctgataaa ggatctgtat ccataaaata caaagaacac ttacaactca
122521    gtaacaagaa ggcagacaac ccaatcaaat aatgggcaaa agaaatgaac aaatatgtca
```

FIGURE 4-HH

```
122581    ttaaagaagg tacacaaatt atgaatagtt acacgaaaag atgctcaaca ttattaatca
122641    ttagaaaaat ggaaactaaa accatagtga tagacggttt tatacctact agaatggcaa
122701    taataataat gataggcaat aacaagcatt ggcaaggatg tggagaaatg ggaaccctca
122761    cacagtgctg gtggggatgt aaaatggtac agcccttcgg aaaacagtgt ggcagtttct
122821    caaaaagtta aatgtaaaac tgccatacaa cccaaaattc cactcccagg tgtctactca
122881    ggagaaacga aaacaaacat aacaaaactt aaatatgaat attaataata atcatattta
122941    tgtatgtaaa tatgatgtat catttatgta tgtaaatatg atatatcata ttatgtatca
123001    ttatatataa tagccccaag ctggcaataa cctaaatttt tagcagctgg tgagtagata
123061    gacaaaatgt ggtgaatcca tacaatagaa gactgtgcag caatgaaacg tgatgacaca
123121    tgctatgtcg tggatgagcg tcaaaaacat tatgttaagt gaaagaagcc agacctaaga
123181    ggcttcatgt ggcatgattt cacttacatg aaatgtgcag ggaaggcaaa tttatagagg
123241    cagaaagtag attagtagtt gcctggggct ggaagtgaca acagggatta attgtaaatg
123301    ggcatgaggg gggataagaa ttgaggggat gattctgagt ttctgtgggg tgtatccatg
123361    agggaaagta ttctaaggaa attggcatgt ggctccataa aaatctatca tctgagacaa
123421    actccattcc catcatgaac tttaaaatat tggttggaag ccaagcatgg tggctcatac
123481    ctgtaattcc agcactttgg gaggccaagg caggtagatc acttgagcca gggattctag
123541    aacagcttgg gcaacatggt gaaacccgt ctctacataa aaatacaaaa aatttagccc
123601    agtgtggtgg tccacgcctg tagtcctagc tatgcaggaa gctgagatgg gaggatctct
123661    ttagctcagg aggtagaggc tgcagtgggc tatgactgtg ccactgcagt ccagcctggg
123721    ttgatagagt gagaccctgt ctcaaaaaaa aaaaaaaaaa aaaataggaa ttgctggatg
123781    gtaatgttgt aggagttttct cctcagttca gccaaagaca gggtccttgt cacctggcca
123841    tgaaatatta ggcttgcaga cactttgaag ggtgagaaaa atggaattta ttgggcaaaa
123901    aaaaaaagcg gggaaacggg gaccctcggc agagtgagag tcctgctagt cacgcttcc
123961    caccctctcag gttgaatccc aggttccacc ctggaagagg aggggccagg ctcctcagca
124021    cgaacttcca gaggctccac cccagtgcac attcctccca gtgtgcgggt ttgtcagagg
124081    ttctctgggg accccttttac acttggctgt ctcattcccc cctctcaaga agtacatcaa
124141    actactgtta gaacaaggat aggggtgagg acgaagaccg atctaaactg cttcctgcta
124201    acagggagcg gtgttttggg aaacggcagt cagagctccc tcagaagcct atctaagggt
124261    tcccggcaga aggcgccatc ttccgaggct ccggttgcac gaccatttgg agtttgatgg
124321    cctgaaggca agaggagaaa aaccaggtta ttagaaaaca tgtgttaaaa cgaaacaagg
124381    gagggtaagg acagcttaaa atccctaggc cttttaccag tttgcacagg gagagggaaa
124441    ccaaaagccc gactggtaaa aaaaacttta ccctttttgcc agcatgtcat gcttgtgggt
124501    tcccttcctc tgagcccaat cctaagccaa ccagctgaag gtttgggaaa ttaactcttt
124561    ccagtttgga ggatgcatct gagggagtg tcctatagta caaagacaca attacctatt
124621    agtgaagaga agacagtgga gaagaaagga aaaaaaggtg cttttttaaag gagtcccagg
124681    ggttcagcat gcattcaaaa ggggtacaga gtgaagatga atggctaccc atctagaaag
124741    aggggagcag gcatccctgt ctcctatctc tttctagcag ataccagggg tacatgaggg
124801    agagaaggaa gagcgtcctc tttccctctt ctgtccttgc atacccaagt cctggtgacc
124861    ttggcaggtg ctgccatggg tgccacagca gcttgcaccc atgaagcagg gagtacctag
124921    agaataggaa ttatcagcca gactcagtgg ctcacgcctg tacaacccag caccttggga
124981    ggccgaggtg ggcagatcat gatttcagga gtttgagacc agcctggcca acatggtgaa
125041    accccgtctc tactaaaaat acaaaactta gctgggtgtg tggtgcatg cctgtagtcc
125101    cagctactcg ggaggctgag gcaggagaat cacttggtcc caggaggcaa aggttgcagt
125161    gagccaagat cacaccactg cactccagcc tgggcaacag agtaagactc catctcgggg
125221    aaaaaaaaag agagaatagg aattatccgc tcttacctat gtttctatac cccctacagt
125281    cagtagtctt ggagtttcct agacctcatt tatgctgtgg ggaaaagcaa gagagatcag
125341    attgttactc tgtctgtgta gaaagaagta gacataggag actccatttt gttatgtact
125401    aagaaaaatt cttctgcctt gagattctgt taatctataa ccttaccccc aaccctgtgc
125461    tctctgaaac atgtgctgtg tcaactcaga gttgaatgga ttaagggcgg tgcaagatgt
125521    gctttgttaa acagatgctt gagggcagca tgctccttaa gagtcatcac cactccctaa
125581    tctcaagtac ccagggacac aaaaactgcg gaaggccgca gggacctctg cctaggaaaa
125641    ccagatattg tccaaggttt ctccccatgt gatagtctga aatatggcct cgtgggaagg
125701    gaaagacctg accgtccccc agcccgacac ccgtaaaggg tctgtgctga ggaggattag
125761    taaaagagga aggaatgcct cttgcagttg agacaagagg aaggcatctg tctcctgcct
125821    gtccctgggc aatggaatgt ctcggtataa aacccgattg tatgctccat ctactgagat
125881    agggaaaaac cgccttaggg ctggaggtgg gacctgcggg cagcaatact gctttgtaaa
125941    gcattgagat gtttatgtgt atgcatatct aaaagcacag cacttaatcc tttacattgt
126001    ctatgatgca aagacctttg ttcacgtgtt tgtctgctga ccctctcccc acaattgtct
126061    tgtgaccctg acacatcccc ctctttgaga aacaccaca gatgatcaat aaatactaag
126121    ggaactcaga ggctggcggg atcctccata tgctgaacgc tggttcccag ggtcccctta
126181    tttcttctctc tatactttgt ctctgtgtct ttttcttttc caaatctctc gtcccacctt
126241    acgagaaaca cccacaggtg tgtaggggca acccaccccct acatatgcca tggatactag
```

FIGURE 4-II

```
126301    catgacctttt atccatgaaa tgggaggctt ggcttgattg gcaggaatta gccatgctca
126361    cttgcacgca ctgtgccttt tttttttttt tttttttttt tttttttgag acagagtctc
126421    gctctgttgc caggctgaag tgcagtggag tgaactcggc tcactgcaac ctccgactcc
126481    ctggttcaag tgattctcct gcctcagcct cctgagtagc tgggattaca ggcacgcacc
126541    accatgccca gctaattttt gtatttttt tttcgagatg gagtcttgct ctgtcgccca
126601    gtctggagtg cagtggcatg atctcagctc actgcaacct ccacctccca gttcaagcga
126661    ttctcctgcc tctacctccc aagtagctag gattacaggt gcatgccacc atgcctggct
126721    aattttgta tatttagtag agacggggtt tcaccgtgtt tgccaggatg gtcccgatct
126781    cctgacctca tgatctgccc gccttggcct cccaaagtgc tgggattaca ggtgtgagcc
126841    actgtgcccg gccttgcact gtgccttta acccctgtta tcatctgcct ctgaatccct
126901    tagatccagt tttctttcct ggggctttga ctcaaagctt ggaatagaat ttgaaacaaa
126961    aatatgtgtc taggaagggc tgcatggact ccttatcata agccaaatgc taaggaaggt
127021    gaagctgcag aattgagtcc tcctccaaca agggagagaa aaagatgtct tgtgacatgc
127081    ccagataatt ggtggctata gttatgtaag ctaggatttg ggtgcatggt gcttggcttt
127141    ggttagctct tactttccaa aaaaggaaac ctccgattaa tgggcatcct atttattccc
127201    atcacctggc aggatttgca ggataattgc tcagaactaa aatattgatc cagattttta
127261    cattacccat cctctccttc tttctgagct gcagctggag attgctggtt ggttcacagg
127321    aacaaggagt gttagcctaa aaatgtaggc aaaaacttaa acactaatga ctttagaatt
127381    tattgacaaa tgtatggtgt tttgaaacat aatttctctc tctccagtcc tcatttttgt
127441    taaaaaagca aattatgggt ggattgagtt gtttgcaaaa tagactttag tcatatactt
127501    ggcctgatta tttgcataaa gtgcagcaag aataactatt tctacataag tcttttagat
127561    tggctttgat ggaactctgt tcttcaagga atttcagaca aaacgtttta aaactgagcc
127621    cagccatgga tttgtatcct caaatacctg taagttggat gatcttctcg tgttaaggtc
127681    ccatgacaaa tttggagctc ctagacctgt tagaaagtga cattcttggc caggcgtggt
127741    ggctcacacc tgtaatccta gcaccttggg aggccgaggt gggcggatca ccggaggtca
127801    ggagttcgag accagcctgg ccaacatggt gaaaccctgt ctctacttaa aatacaaaaa
127861    attagctggg tgtggtggca agtgcctgta gtcccagcta tttgggaaac tgaggcagga
127921    gaatcacttg aacctgggag gcggaggttg cagtgagccg agatcatgcc actgcactcc
127981    agcttggcga cagagcaaga gtctgcctca aaaaaaaaaa aaaagaata ctcacggata
128041    atttccaaat tctggagaag ccaggcagag agagagaaaa atatgcttca aattttgttc
128101    acaggagtgt agcttactct agtattaaag gccttaaaga gttcaaaata attttccttg
128161    actctgagaa acaaaacaag gatcagcaat attccaagca aaagtcaaaa aggttgcttc
128221    agctttctga gttcagtcca ttcagttctt gttatgcttg atattcgtga acatttttagc
128281    tcttcatgag tcctgtacat tttcctttat tccaatatca cagtctccaa agttatcaga
128341    aacctgtatt tgagagcacc tgtcagagtc ctatagctta ttacaaacca actttatttt
128401    ttttgagac aggatcttgc tctgttgccc aagctggaat gcagtggtga gatcttggct
128461    cactgcaacc tccacctcct ggattcaagc gattctcctg ccccaacatc ctgagtagct
128521    gggattacag gtatgtgcca ccatgcccgg ctaatttttg tatttttttt ttttagtag
128581    agatgggtt ttaccatgtt gaccaggttg gttttgaact cctgacctca ggtgatacc
128641    ctgacttggc cttccaaagt gctgggatta aggtgtgag ccactgcacc cagccggatc
128701    aggcactttt aacttgaaaa catgaagttc tctttcctaa cttttttctt tctttctttt
128761    ttttttttt ttccgagaca ggatctcact ctgtcaccca ggctggagtg cagggatgcc
128821    atcacagctc actgcagccc tgacctcctg ggctcaagca atcctcccag ctcatcctcc
128881    caaatggctg ggactagg cttagaccac catacccaac taattttgt attttgtgt
128941    gaagatgagg tctccctatg tttcccaggc tggtcttgat ctcctgggct caagcaatcc
129001    atcagccttg gcctcccaaa gcactgggat tataggcatg agccaccaag gacggcccc
129061    taatgttttt tatattggct aatgagcttt aagtttatac atacaaggca taaagaaata
129121    actttaaagt tatgttatta gatgtacagt gatatgattt agctctgtgt ccccacccaa
129181    gtctcatctt gtagctccca taactcccat gtgttgtgaa agggacctgg tgggagatga
129241    ttgaatcgtg gaggtgggtc tttcccgtgc tgttctcatg ataatgaatg ggtctcacaa
129301    gatctgatgg ttttaaaaac gggagtttct ctgcacaagc tctctctttg cctggtgcca
129361    tccacataag atgtgacttg cttctccttg ccttccacca tgattgtaag gtctccccag
129421    ccatgtggaa ctgtaaatcc aataaacctc tttcgtaaat tgcccagtct tgcatatgtc
129481    tttatcagca gcgtgaaaac agatgaatac agtaaatttg tactgggagt ggggcattgc
129541    tgaaagata cccaaaaatg tggaagcgac tttggaactg gggaacaggc agaggttgga
129601    acagtttgga gcgctcagat gaagacagga aaatgtggga aagtctggag cttcctagag
129661    acttgttgaa gggccttgac caaaagcctg atagtgatat ggacaataag gtccaggctg
129721    aggtggtctc agatgaagat gaggaacttg ttgggaactg gagcaaaggt aactcttgta
129781    tgtttagca aagagactgg cagcattttg tccctgccct agagatttgc agaactttga
129841    actcgagaga gatggttag gctatctggt ggaagaaatt tgtttattat tattattatt
129901    attattatta ttattattat tttgagatag agtctcactc tgtcacccag gccagaggac
129961    agtagcgtga ccttggctca ctgcaacctt cgcctcctga gttcaagcgt ttctcatgtc
```

FIGURE 4-JJ

```
130021    tcggcctccc aagcagctga gataacaggc atgtgcctcc atgcctggct aattttttgta
130081    ttttagaaga gacagggatt caccacattg gccaggctgg tctcaaactc ctgacctcaa
130141    atgatccaac tcagcctcct gaagtgttgg aattacaggc atgagccacc acacctggct
130201    gcggaagaaa tttctaagct gcaaagcatt caagaggtga cttgggtgtg gttaaaggaa
130261    ttcagtttta taagggaagc agagaataaa ggttcagaaa atttgcagcc tgacaatgcg
130321    atagaaaaga aaagccaatt ttctgaggag aaattcaagc cagctgcaga aatgtgcata
130381    agtaacaaga ggaacattaa ccccccaatac aatggggaaa atgtctccag ggcatgtcag
130441    aggtcttctt ggcagcccct cccatcacag gcccagaggc ctaggagaaa tggttccgtg
130501    ggccaggtcc agggtccccg tgctgtatgt agcctaggga cttggtgcct tgtgtcccag
130561    ctgctccagc catggctgaa aggggccaac atagagctta ggccatggct gcagagggtg
130621    aaagccccag tccttggcag cttccacgtg gtattgagct tgcaagtgca cagaagtcaa
130681    gaattggggt ttgggaacct ccacctagat ttcagaagat gtatggaaat gcctggatgc
130741    ccaggcagaa gtttgctgca ggggtggggt gctcatggag aacctctgct agggcagggc
130801    ggaagggaaa tgtggggttg gagctcccac acagagtcct tactggggca ctgcctaggg
130861    cagctgtgag aagagggcca ttgtcctcta gccccaagaa tggtagatcc actgacagct
130921    tgcactgttt gcctggaaaa gctgcagaca ctcaatgcca gcctgtgaaa gcagccggga
130981    gggaggctgt acactgaaaa gccacagggg cggagctgcc agagaccatg ggaacccacc
131041    tcttacatta gtgtgacctg atatgagaga tggagtcaaa ggagatcatt ttggagcttt
131101    aagatttgac tgccctgctg gattttggac ttgcaggggc ctgtagcccc tctgttttgg
131161    ctaatttctc ccatttttgga gtggctgtat ttacccaata cctgtactcc cattgtatcc
131221    aggaagtaac taacttgctt ttgattttac aggctgatag gcagaagtgt cttgcttttt
131281    ctttgctgag actttggact gtggactttt gagttaattc tgaaatgagt tgagactttg
131341    ggggactgtt gggaaggcat gattggtttt gaaatgtgaa gatatgagat ttgggagggg
131401    acagggatgg aatgatatgg cttggctgtg tccccaccca aatctcatct tgtagctccc
131461    ataattcact catgttgtgg gagggacctg gtgggagatg attgaatcat ggggtgggt
131521    cttttcccatg ttcttgtgag agtgaatggg tctcacgaga tctgatggtt tttaaaacag
131581    gagtttctct gcacaagctc tctctttgcc tgctgtcatc cacataagat gtgacttgct
131641    cctccttgcc ttctgccatt attgtgaggt ctccccagcc atgtggaact gtaagtccaa
131701    tgaacctctt tcttttgtaa attgctctat ctcgggtatg tctttatcat tcctgaaaat
131761    ggactaatac atacggcaat actcaagaga gcaagtgtgg atagcttggg ttcatgaggt
131821    ttttggtttt tgtcaaaagc ataaatgtat actgaaacta cccagaaaaa gcaaagtata
131881    aaacagtatg ctaccatttg tgcccataaa tgggatatgt gtagtgtaaa tgcatagaat
131941    ttgaccagat gtatacccag agaccagaac actcagtggc ctcatgttca tactttggca
132001    aacacatgta tagtatcctt aacttaaatg taccattgtt gtgtgcattc tagtgttatt
132061    gacatttaca tatctattat caagtcagat aaatcattct gtgtctttgt attttcactt
132121    cctatttttgt atatttatgt atacatacac ataccaat acatatttaa ataaggtata
132181    acttcacctg gtccaaaaat caaaacaacg tagaaaggtt tacagtgaaa ggtcgcatcc
132241    ctgatgctgt cctcttcccc caggtgatca ccttattggt ttcttttcat accttttcagc
132301    attttctcct gcaagcacag atattctaac tcctcctttt ttacacagaa ttttttttta
132361    catagcattc ttctgcacct tccttctccc acttacaat gcacatggag atttttccgt
132421    atttgtacat caggagcttc ctctttcttt gttaccacat taaattccac tgggtagatg
132481    taccataatt taactgggtc cttattgaaa gacaattgag ctgtctccta gacaaagcct
132541    tgtgcacctt cccgaacaga gggtctaacc aagcaggcag gatgggggta taaagtaggt
132601    ggggaggtgg gagagactcc accctcccag gtgggctgag gatggaggta aggccctgca
132661    acaggacaga ggggaaagtg gggatgagac atgggaggcg agatagcgct cactgttctc
132721    gctcagcccc ctcctccatt tgccgctgac ctgttggcct cccccaacct ctgagcctgc
132781    ctctgcctag gtaatttccc aagaccagg agggggtgaag ggtgaggtgc gattgccccc
132841    acctccttgc ctcccgcagc atctgctcca ggaccatgaa caatagctga cagctccatg
132901    gcccttgctg tccccatctc agcttccctg ggcatctaaa cctcagttgc cRtggggtag
132961    gaggacaggc tgaggaagca gaagcctgag gctgtctaga gtctcactcc tgcatcagca
133021    ggccaccacc tgtggttcct ccttgtgcaa atttgagagg aattgcataa aacactggag
133081    aaatccaaga ggggaagtcc
```

```
  1        agttggctgc cacagcctct gccaagcttt gtctttgggg cttgctgcag aaacctggcc
 61        tacggaagat acgacaccac tgggagggtt gtgtaggtgc caggggacca tcgtggttct
121        ctagggcgct gtggaaattg ggtcttgggc tgggtggcat ctggcagtca tggRtaacac
181        ttgcttttcc agttaatgtg gccatgtgat tccaagtgtc atgttgcttt gtggcaagat
241        tgttgtgtga cttgttttt tgttttgtt tttgttttt taaaggaaac tatttgtggg
```

FIGURE 6-A

NM_000201 [gi:4557877] Homo sapiens intercellular adhesion molecule 1 (CD54), human rhinovirus receptor (ICAM1), mRNA

```
gcgcccagtcgacgctgagctcctctgctactcagagttgcaacctcagcctcgctatggctcccagcagccccg
gcccgcgctgcccgcactcctggtcctgctcggggctctgttcccaggacctggcaatgcccagacatctgtgtccc
cctcaaaagtcatcctgccccggggaggctccgtgctggtgacatgcagcacctcctgtgaccagcccaagttgttg
ggcatagagaccccgttgcctaaaaaggagttgctcctgcctgggaacaaccggaaggtgtatgaactgagcaatgt
gcaagaagatagccaaccaatgtgctattcaaactgccctgatgggcagtcaacagctaaaaccttcctcaccgtgt
actggactccagaacgggtggaactggcacccctcccctcttggcagccagtgggcaagaaccttaccctacgctgc
caggtggagggtggggcaccccgggccaacctcaccgtggtgctgctccgtggggagaaggagctgaaacgggagcc
agctgtgggggagcccgctgaggtcacgaccacggtgctggtgaggagagatcaccatggagccaatttctcgtgcc
gcactgaactggacctgcggccccaagggctggagctgtttgagaacacctcggcccctaccagctccagacctt
gtcctgccagcgactcccccacaacttgtcagcccccgggtcctagaggtggacacgcaggggaccgtggtctgttc
cctggacgggctgttcccagtctcggaggccaggtccacctggcactgggggaccagaggttgaacccacagtca
cctatggcaacgactccttctcggccaaggcctcagtcagtgtgaccgcagaggacgagggcacccagcggctgacg
tgtgcagtaatactggggaaccagagccaggagacactgcagacagtgaccatctacagctttccggcgcccaacgt
gattctgacgaagccagaggtctcagaagggaccgaggtgacagtgaagtgtgaggcccaccctagagccaaggtga
cgctgaatggggttccagcccagccactgggcccgagggcccagctcctgctgaaggccaccccagaggacaacggg
cgcagcttctcctgctctgcaaccctggaggtggccggccagcttatacacaagaaccagacccgggagcttcgtgt
cctgtatggccccgactggacgagagggattgtccgggaaactggacgtggccagaaaattcccagcagactccaa
tgtgccaggcttggggggaacccattgcccgagctcaagtgtctaaaggatggcactttcccactgcccatcggggaa
tcagtgactgtcactcgagatcttgagggcacctacctctgtcgggccaggagcactcaaggggaggtcacccgcga
ggtgaccgtgaatgtgctctccccccggtatgagattgtcatcatcactgtggtagcagccgcagtcataatgggca
ctgcaggcctcagcacgtacctctataaccgccagcggaagatcaagaaatacagactacaacaggcccaaaaaggg
accccatgaaaccgaacacacaagccacgcctccctgaacctatcccgggacagggcctcttcctcggccttccca
tattggtggcagtggtgccacactgaacagagtggaagacatatgccatgcagctacacctaccggccctgggacgc
cggaggacagggcattgtcctcagtcagatacaacagcatttggggccatggtacctgcacacctaaaacactaggc
cacgcatctgatctgtagtcacatgactaagccaagaggaaggagcaagactcaagacatgattgatggatgttaaa
gtctagcctgatgagaggggaagtggtgggggagacatagccccaccatgaggacatacaactgggaaatactgaaa
cttgctgcctattgggtatgctgaggcccacagacttacagaagaagtggccctccatagacatgtgtagcatcaaa
acacaaaggcccacacttcctgacggatgccagcttgggcactgctgtctactgaccccaaccttgatgatatgta
tttattcatttgttatttaccagctatttattgagtgtcttttatgtaggctaaatgaacataggtctctggcctc
acggagctcccagtccatgtcacattcaaggtcaccaggtacagttgtacaggttgtacactgcaggagagtgcctg
gcaaaagatcaaatgggctggacttctcattggccaacctgcctttccccagaaggagtgattttctatcggc
acaaaagcactatatggactggtaatggttcacaggttcagagattacccagtgaggccttattcctcccttccccc
caaaactgacacctttgttagccacctcccacccacatacatttctgccagtgttcacaatgacactcagcggtca
tgtctggacatgagtgcccagggaatatgcccaagctatgccttgtcctcttgtcctgtttgcatttcactgggagc
ttgcactattgcagctccagtttcctgcagtgatcagggtcctgcaagcagtggggaaggggccaaggtattggag
gactccctcccagctttggaagggtcatccgcgtgtgtgtgtgtgtatgtgtagacaagctctcgctctgtcacc
caggctggagtgcagtggtgcaatcatggttcactgcagtcttgaccttttgggctcaagtgatcctcccacctcag
cctcctgagtagctgggaccataggctcacaacaccacacctggcaaatttgatttttttttttttttcagagacg
gggtctcgcaacattgcccagacttcctttgtgttagttaataaagctttctcaactgcc
```

FIGURE 6-B

NM_001544 [gi:12545400] Homo sapiens intercellular adhesion molecule 4,
Landsteiner-Wiener blood group (ICAM4), transcript variant 1, mRNA.

cttttttgccatggggtctctgttccctctgtcgctgctgttttttttggcggccgcctacccgggagttgggagcgc
gctgggacgccggactaagcgggcgcaaagccccaagggtagccctctcgcgccctccgggacctcagtgcccttct
gggtgcgcatgagcccggagttcgtggctgtgcagccggggaagtcagtgcagctcaattgcagcaacagctgtccc
cagccgcagaattccagcctccgcaccccgctgcggcaaggcaagacgctcagagggccgggttgggtgtcttacca
gctgctcgacgtgagggcctggagctccctcgcgcactgcctcgtgacctgcgcaggaaaaacacgctgggccacct
ccaggatcaccgcctacaaaccgccccacagcgtgattttggagcctccggtcttaaagggcaggaaatacactttg
cgctgccacgtgacgcaggtgttcccggtgggctacttggtggtgaccctgaggcatggaagccgggtcatctattc
cgaaagcctggagcgcttcaccggcctggatctggccaacgtgaccttgacctacgagtttgctgctggaccccgcg
acttctggcagccgtgatctgccacgcgcgcctcaatctcgacggcctggtggtccgcaacagctcggcacccatt
acactgatgctcgcttggagccccgcgcccacagctttggcctccggttccatcgctgcccttgtagggatcctcct
cactgtgggcgctgcgtacctatgcaagtgcctagctatgaagtcccaggcgtaaaggggatgttctatgccggct
gagcgagaaaaagaggaatatgaaacaatctggggaaatggccatacatggtggctgacgcctgtaatcccagcact
ttgggaggccgaggcaggagaatcgcttgagcccaggagttcgagaccagcctggacaacatagtgagaccccgtct
atgcaaaaaatacacaaattagcctggtgtggtggcccgcacctgtggtcccagctacccgggaggctgagttggga
ggatcctttgagccctgaaagtcgaggttgcagtgagccttgatcgtgccactgcactccagcctgggggacagagc
acgaccctgtctccaaaaataaaataaaataaaataaatattggcggggaaccctctggaatcaataaaggctt
ccttaaccagc

FIGURE 6-C

NM_003259 [gi:12545403] Homo sapiens intercellular adhesion molecule 5, telencephalin (ICAM5), mRNA

```
ccgtcctctagcccagctcctcggctcgcgctctcctcgcctcctgtgctttccccgccgcggcgatgccagggcct
tcgccagggctgcgccgggcgctactcggcctctgggctgctctgggcctggggctcttcggcctctcagcggtctc
gcaggagcccttctgggcggacctgcagcctcgcgtggcgttcgtggagcgcggggctcgctgtggctgaattgca
gcaccaactgccctcggccggagcgcggtggcctggagacctcgctgcgccgaaacgggacccagaggggtttgcgt
tggttggcgcggcagctggtggacattcgcgagccggagactcagcccgtctgcttcttccgctgcgcgcggcgcac
actacaggcgcgtgggctcattcgcactttccagcgaccagatcgcgtagagctgatgccgctgcctcctggcagc
cggtgggcgagaacttcaccctgagctgtagggtccccggcgccgggccccgtgcgagcctcacgctgaccctgctg
cggggcgcccaggagctgatccgccgcagcttcgccggtgaaccaccccgagcgcggggcgcggtgctcacagccac
ggtactggctcggagggaggaccatggagccaattttctcgtgtcgcgccgagctggacctgcggccgcacggactgg
gactgtttgaaaacagctcggcccccagagagctccgaaccttctccctgtctccggatgccccgcgcctcgctgct
ccccggctcttggaagttggctcggaaaggcccgtgagctgcactctggacggactgtttccagcctcagaggccag
ggtctacctcgcactgggggaccagaatctgagtcctgatgtcaccctcgaaggggacgcattcgtggccactgcca
cagccacagctagcgcagagcaggagggtgccaggcagctgatctgcaacgtcaccctgggggcgaaaaccggag
acccgggagaacgtgaccatctacagcttcccggcaccactcctgaccctgagcgaacccagcgtctccgaggggca
gatggtgacagtaacctgcgcagctgggacccaagctctggtcacactggagggagttccagccgcggtcccggggc
agcccgcccagcttcagctaaatgccaccgagaacgacgacagacgcagcttcttctgcgacgccaccctcgatgtg
gacggggagaccctgatcaagaacaggagcgcagagcttcgtgtcctatacgctccccggctagacgattcggactg
ccccaggagttggacgtggcccgagggcccagagcagacgctgcgctgcgaggcccgcgggaacccagaaccctcag
tgcactgtgcgcgctccgacggcggggccgtgctggctctgggcctgctgggtccagtcactcgggcgctctcaggc
acttaccgctgcaaggcggccaatgatcaaggcgaggcggtcaaggacgtaacgctaacggtggagtacgcaccagc
gctggacagcgtgggctgcccagaacgcattacttggctggagggaacagaagcctcgctgagctgtgtggcgcacg
gggtaccgccgcctgatgtgatctgcgtgcgctctggagaactcggggccgtcatcgaggggctgttgcgtgtggcc
cgggagcatgcgggcacttaccgctgcgaagccaccaaccctcggggctctgcggccaaaaatgtggccgtcacggt
ggaatatggccccaggtttgaggagccgagctgccccagcaattggacatgggtggaaggatctgggcgcctgtttt
cctgtgaggtcgatgggaagccacagccaagcgtgaagtgcgtgggctccggggcgccactgaggggtgctgctg
ccgctggcaccccagaccctagtcccagagctcccagaatccctagagtcctggcacccggtatctacgtctgcaa
cgccaccaaccgccacggctccgtggccaaaacagtcgtcgtgagcgcggagtcgccaccggagatggatgaatcta
cctgcccaagtcaccagacgtggctggaaggggctgaggcttccgcgctggcctgcgccgcccggggtcgcccttcc
ccaggagtgcgctgctctcgggaaggcatcccatggcctgagcagcagcgcgtgtcccgagaggacgcgggcactta
ccactgtgtggccaccaatgcgcatggcacggactcccggaccgtcactgtgggcgtggaataccggccagtggtgg
ccgaacttgctgcctcgcccctggaggcgtgcgcccaggaggaaacttcacgttgacctgccgcgcggaggcctgg
cctccagcccagatcagctggcgcgcgcccccgggggccctcaacatcggcctgtcgagcaacaacagcacactgag
cgtggcaggcgccatgggaagccacggcggcgagtacgagtgcgcacgcaccaacgcgcacgggcgccacgcgcggc
gcatcacggtgcgcgtggccggtccgtggctatgggtcgccgtgggcggcgcggcggggggcgcggcgctgctggcc
gcggggccggcctggccttctacgtgcagtccaccgcctgcaagaagggcgagtacaacgtgcaggaggccgagag
ctcaggcgaggccgtgtgtctcaacggagcgggcggcggcgctggcggggcggcaggcgcggagggcggacccgagg
cggcgggggcgcggccgagtcgccggcggagggcgaggtcttcgccatacagctgacatcggcgtgagccgctccc
ctctccccgcgggccggggacgccccccagactcacacggggcttatttattgctttatttatttacttattcat
ttatttatgtattcaactccaagggcgtcaccccccatttctacccatcccctcaataaagtttttataagga
```

FIGURE 7

NM_003259 [gi:12545403] Homo sapiens mitogen-activated protein kinase 10 (MAPK10), transcript variant 1, mRNA.

```
gagaaatggcgtggcaggggacccagcgagcccagagggattttgccgctgcttcctctaccsctgtatttcacgca
gctctctaaattgactcagctccaggctagtgtgagaaacaccaacagcaggcccatctcagatcttcactatggca
acttatgcaagaaactgttgaattagacccgtttcctatagatgagaaaccatacaagctgtggtatttatgagcct
ccatttcttatactactgcagtgaaccaacattggatgtgaaaattgccttttgtcagggattcgataaacaagtgg
atgtgtcatatattgccaaacattacaacatgagcaaaagcaaagttgacaaccagttctacagtgtggaagtggga
gactcaaccttcacagttctcaagcgctaccagaatctaaagcctattggctctggggctcagggcatagtttgtgc
cgcgtatgatgctgtccttgacagaaatgtggccattaagaagctcagcagaccctttcagaaccaaacacatgcca
agagagcgtaccgggagctggtcctcatgaagtgtgtgaaccataaaaacattattagtttattaaatgtcttcaca
ccccagaaaacgctggaggagttccaagatgtttacttagtaatggaactgatggatgccaacttatgtcaagtgat
tcagatggaattagaccatgagcgaatgtcttacctgctgtaccaaatgttgtgtggcattaagcacctccattctg
ctggaattattcacagggatttaaaaccaagtaacattgtagtcaagtctgattgcacattgaaaatcctggacttt
ggactggccaggacagcaggcacaagcttcatgatgactccatatgtggtgacacgttattacagagcccctgaggt
catcctggggatgggctacaaggagaacgtggatatatggtctgtgggatgcattatgggagaaatggttcgccaca
aaatcctctttccaggaagggactatattgaccagtggaataaggtaattgaacaactaggaacaccatgtccagaa
ttcatgaagaaattgcaacccacagtaagaaactatgtggagaatcggcccaagtatgcgggactcaccttccccaa
actcttcccagattccctcttcccagcggactccgagcacaataaactcaaagccagccaagccagggacttgttgt
caaagatgctagtgattgacccagcaaaaagaatatcagtggacgacgccttacagcatccctacatcaacgtctgg
tatgacccagccgaagtggaggcgcctccacctcagatatatgacaagcagttggatgaaagagaacacacaattga
agaatggaaagaacttatctacaaggaagtaatgaattcagaagaaaagactaaaaatggtgtagtaaaaggacagc
cttctccttcagcacaggtgcagcagtgaacagcagtgagagtctccctccatcctcgtctgtcaatgacatctcct
ccatgtccaccgaccagaccctggcatctgacactgacagcagcctggaagcctcggcaggacccctgggttgttgc
aggtgactagccgcctgcctgcgaaacccagcgttcttcaggagatgatgtgatggaacacacacacacgcagacac
acacacacacaaatgcagacacacaacatcaagaaaacagcaagggagagaatccaagcctaaaattaaataaat
ctttcagcctgcttcttccccagggttctgtattgcagctaagctcaaatgtatatttaacttctagttgctcttgc
tttggtcttcttccaatgatgcttactacagaaagcaaatcagacacaattagagaagccttttccataaagtgtaa
ttttaatggctgcaaaaccggcaacctgtaactgccctttaaatggcatgacaaggtgtgcagtggccccatccag
catgtgtgtctctatcttgcatctacctgctccttggcctagtcagatggatgtagatacagatccgcatgtgtc
tgtattcatacagcactacttacttagagatgctactgtcagtgtcctcagggctctaccaagacataatgcactgg
ggtaccacatggtccatttcatgtgatctattactctgacataaacccatctgtaatatattgccagtatataagct
gtttagtttgttaattgattaaactgtatgtcttataagaaaacatgtaaggggggaatatatgggggagtgagct
ctctcagacccttgaagatgtagcttccaaatttgaatggattaaatggcacctgtatacca
```

Other isoforms are isoform 2 (NM_138982); isoform 3 (NM_138980); isoform 4 (NM_138981)

FIGURE 8-A

NM_015078: KIAA0861

```
ttgggcggagatgcctttaaaaaatcatccaccgcagcggtagaaacagttttgtttggctttatttatacggaatggtt
tttcagtgaaatgctgtcttgcttaaaagaagagatgcctccccaggagctcacccggcgactggccacagtgatcactc
atgtcgatgaaattatgcagcaggaagtcagaccctgatggcggtggagataatagaacaacttcacagacaatttgcc
attctttcaggaggccgaggggaggatggcgccccatcatcacgttcccagagttttcggggttcaaacacatcccaga
tgaagacttcctgaatgtcatgacctacctgactagcatccccagtgtggaggctgccagcattggattcattgttgtta
tcgacagacgaagagacaagtggagctccgtaaaggcatccttgacacgaatagctgtggcatttccaggaaacttacag
ctcatattcatccttcgtccatctcgctttatccagaggacattcactgacattggcattaaatactatcgaaatgagtt
taaaacgaaagtgccgatcatcatggtaaactctgtctctgaccttcacggctacatcgacaaaagccaactgacccggg
aattagggggactttggaatatcgccacggtcagtgggtaaatcaccgcactgccatcgaaaactttgccttgaccttg
aagaccactgcccagatgctgcagacgtttgggtcctgcctggccacagcagagctgcccagaagcatgctatccacgga
agaccttctcatgtcccacacaaggcagcgggacaagctgcaggatgagctgaaattacttggaaagcaggggaccacat
tgctgtcatgcatccaagaaccagcaaccaaatgtcccaacagcaaactcaatctcaaccaacttgagaatgtaactacc
atggaaaggttattagttcaactggatgaaacagaaaaagcctttagtcacttttggtctgagcatcatctgaagcttaa
ccagtgcctacaactacagcatttgagcacgattttgtaaggctaagcttgccctggataatttgctggaagagcaag
cagagtttacaggcattggagacagcgtgatgcacgtggagcagattcttaaggaacacaaaaaactggaggaaaaaagc
caggagcccctggaaaaggcccagctgctggcactggttggggaccagctcatccaaagccaccattatgcagcagatgc
catcaggccccgtgtgtggagctcaggcacctctgtgacgatttcatcaatggaaacaagaaaaaatgggacattttag
gaaagtccttagagtttcatagacagctggacaaggtcagccaatggtgtgaggcaggaatctacctcttggcttcccaa
gctgtagacaagtgccagtctcgagaaggggttgatatcgccttgaacgacattgcgacattcctgggcacagtcaagga
gtacccgttgctcagccccaaggagttttacaacgagtttgagttgctgctcaccctcgatgcaaaggccaaagcccaga
aagttttgcagaggctggatgatgtccaggaaatatttcacaagaggcaagtgagtctgatgaaactggcagccaaacag
actcgtccagtgcaacctgtggccccacatcctgagtcttcaccaaaatgggtgtcatcaaaaaccagccagccctccac
ctcggtccctctagctcgtcctctgagaacgtctgaggaaccttatacggagacagagttgaactcccggggaaaggaag
atgatgagactaaatttgaagtcaagagtgaagaaatctttgaaagccatcatgaaggggggaaccctgagctggagcag
caggccaggctcggagacctttccccccgcaggcgcattatacgtgacttgcttgagactgaagagatttacataaaaga
gattaaaagcataattgatggatatatcactccaatggattttatttggctaaagcatctaattccagatgttcttcaga
ataacaaggactttctctttgggaatattagagaactttacgaatttcacaacaggactttctaaaagagttggaaaag
tgtgctgagaaccctgaacttctggcacattgctttctcaagagaaaagaagatcttcagatatattttaaataccataa
gaatctgccccgagctagggcaatctggcaagagtgtcaagactgcgcctactttggggtatgccagcgccaactggatc
acaatctccctcttttttaagtatctcaaaggaccaagccagagacttataaaataccagatgctgttgaagggtctgctg
gatttcgagtctcctgaagatatggagatagacccaggtgaactaggaggctcggctaaggatgggccaaagagaaccaa
agattcagcattctcaactgaactacaacaagctttggcagtgatagaggatttgatcaagtcctgtgagttggctgtgg
acctagcagcagtgactgaatgtcggacgatattggaaaactaggcaagctgttgctgcacggcccttcagcgtctgg
acaattcacaaggatcgttataaaatgaaggatttgattcgatttaaacccagccagaggcaaatctacctatttgaaag
gggaatagtgttctgtaagatacgaatggagcctgggggaccagggattatctcctcattacagcttcaagaagaccatga
agctgatgacactttcaattcgccagcttggaaggggggagccatagaaagtttgagattgccagtcgaaatggacttgag
aaatacatcctgcaggcagcttcaaaagaaatcagagactgttggttttcagaaataagtaaattattgatggaacaaca
aaataatatcaaagaccaaggaaatccacagtttgaaatgagcacgagcaaaggcagtggagcaggatccggaccatgga
ttaaaaatatggaaagagctaccactagcaaggaagacccggcctccagcacaggagggattaaaggctgctccagcagg
gagtttagctccatggacacctttgaagactgtgaaggcgcagaagacatggaaaaggagagcagtgctctgagtctcgc
gggccttttccagtcggacgacagtcacgaaacctgttcctccaaatctgctttcctggagaggggagaaagcagccagg
gagaaaaagaagaacgcgatgaggaggaaacggcgacccgcagcaccgaggaggagcgcgctgggcgtccacgggccgg
ctggctcctgcggggcgacggctggtttccaggcgagggcgctgcgcccgaggacctccgcccaggagagctgacctcc
ctgcggacgccccgctcctcggctccagagcgcccgcattcccggagaggcggtgtggggcccgggccctgcccagc
tacgcagaaagcagccggagcctcggcggcggcagaaagggggacaaccagggcctcctccgaggagcccgaggggtgtcc
tgggtgcgcgcctagctccgcacggggggacctcggagctgctctaaggcgcctgcagaggcgagcagagcccgcagccca
cgccttctcgaccgcgcacttcgacattcggagccgggcaattctttgctgcgtgggcttctctgtgctcccacggtagg
atgtttagtagcaccctggcctctacccactaggtgccaggaatgcgccaccccatcctccacccgccccaaatcgt
gacaatcaaaaatgcctgcagacacgcccgcatttctccagggcggggtgggaatcggttgagagccgcttagcccgagc
```

FIGURE 8-B

```
cttggaggagccggagccgctcaaacccggcgggggccgcagactgggagctcccggtccgcctcccagcatccctgcga
gcgttcatggggtgttcgtgttagtgccaagattgcttcgttgtagagagagttcgttccaagttactttctgaggtatt
ttatgtatcgatttattagttttaaatgagttttgttagtttcagttgtatttattttagttttattagttgatttt
catttctttgtagctttctggttatttaattttatagtttcagttactggtttatagttactttattttcaaagttattt
agttgttcattttcagttatttatatgtagttgttttgttttaggagttacagatgttcaaattaatttgcttggaattt
atttatttatttatttatttttcgagacggagtctcgctctgtcgcccaggctggagtgcagtggtgtgatctcgg
ctcactgcaaaccgcctcccgggttcacgccattctcctgcctcagcctcctgagtagctgggactacaggcgcccgcca
ccacgcccggctaattttttatttggattttagtagagacggggtttccccgtgttagccaggatggtctcgatctcct
gacctcgtgatccccctgcctcggcctcccaaagtgctgggattacaggcgtgagccaccgcgcccagccggaatttatt
tttaattatctttacaattattatctgagttatttaccttcatagttatttactttatcttattggagtttttgagtta
tttattttttacagtaacttatttgactattaaacactcactggaagttcatg
```

FIGURE 9-A

NM_006185 [gi:5453819] Homo sapiens nuclear mitotic apparatus protein 1 (NUMA1), mRNA.

gcccacgaagaggtacgattccggagaatcgcgaggcagagcgggagcgcgcagccaggtggaaactaattctaagccag
actgctggagatcaccctgttctagtgtgtggaggcttccaccaggagtctggagtgcaatggcacgatctcggctcact
gcaacctccacctcccaggttcaagcgattctcctgcctcagcctcccaagtagctgggattacaggcgcattggagtga
ctgtctggcatcaccaagatgacactccacgccacccggggggctgcactcctctcttgggtgaacagtctacacgtggc
tgaccctgtggaggctgtgctgcagctccaggactgcagcatcttcatcaagatcattgacagaatccatggcactgaag
agggacagcaaatcttgaagcagccggtgtcagagagactggactttgtgtgcagttttctgcagaaaaatcgaaaacat
ccctcttccccagaatgcctggtatctgcacagaaggtgctagagggatcagagctggaactggcgaagatgaccatgct
gctcttataccactctaccatgagctccaaaagtcccagggactgggaacagtttgaatataaaattcaggctgagttgg
ctgtcattcttaaatttgtgctggaccatgaggacgggctaaaccttaatgaggacctagagaacttcctacagaaagct
cctgtgccttctacctgttctagcacattccctgaagagctctcccacctagccaccaggccaagagggagattcgctt
cctagagctacagaaggttgcctcctcttccagtgggaacaactttctctcaggttctccagcttctcccatgggtgata
tcctgcagaccccacagttccagatgagacggctgaagaagcagcttgctgatgagagaagtaatagggatgagctggag
ctggagctagctgagaaccgcaagctcctcaccgagaaggatgcacagatagccatgatgcagcagcgcattgaccgcct
agccctgctgaatgagaagcaggcggccagcccactggagcccaaggagcttgaggagctgcgtgacaagaatgagagcc
ttaccatgcggctgcatgaaaccctgaagcagtgccaggacctgaagcagagaagagccagatggatcgcaaaatcaac
cagctttcggaggagaatggagacctttcctttaagctgcgggagtttgccagtcatctgcagcagctacaggatgccct
caatgagctgacggaggagcacagcaaggccactcaggagtggctagagaagcaggccagctggagaaggagctcagcg
cagccctgcaggacaagaaatgccttgaagagaagaacgaaatccttcagggaaaactttcacagctggaagaacacttg
tcccagctgcaggataacccaccccaggagaagggcgaggtgctgggtgatgtcttgcagctggaaaccttgaagcaaga
ggcagccactcttgctgcaaacaacacacagctccaagccagggtagagatgctggagactgagcgaggccagcaggaag
ccaagctgcttgctgagcggggccacttcgaagaagaaaagcagcagctgtctagcctgatcactgacctgcagagctcc
atctccaacctcagccaggccaaggaagagctggagcaggcctcccaggctcatggggcccggttgactgcccaggtggc
ctctctgacctctgagctcaccacactcaatgccaccatccagcaacaggatcaagaactggctggcctgaagcagcagg
ccaaagagaagcaggcccagctagcacagaccctccaacagcaagaacaggcctcccaggcctccgccaccaggtggag
cagctaagcagtagcctgaagcagaaggagcagcagttgaaggaggtagcggagaagcaggaggcaactaggcaggacca
tgcccagcaactggccactgctgcagaggagcgagaggcctccttaagggagcgggatgcggctctcaagcagctggagg
cactggagaaggagaaggctgccaagctggagattctgcagcagcaacttcaggtggctaatgaagcccgggacagtgcc
cagacctcagtgacacaggcccagcgggagaaggcagagctgagccggaaggtggaggaactccaggcctgtgttgagac
agcccgccaggaacagcatgaggcccaggcccaggttgcagcctagagttgcagctgcggtctgagcagcaaaaagcaa
ctgagaaagaaagggtggcccaggagaaggaccagctccaggagcagctccaggccctcaaagagtccttgaaggtcacc
aagggcagccttgaagaggagaagcgcagggctgcagatgccctggaagagcagcagcgttgtatctctgagctgaaggc
agagaccccgaagcctggtggagcagcataagcgggaacgaaaggagctggaagaagagagggctgggcgcaaggggctgg
aggctcgattactgcagcttggggaggccatcaggctgagactgaagtcctgcggcgggagctggcagaggccatggct
gcccagcacacagctgagagtgagtgtgagcagctcgtcaaagaagtagctgcctggcgtgacgggtatgaggatagcca
gcaagaggaggcacagtatggcgccatgttccaggaacagctgatgactttgaaggaggaatgtgagaaggcccgccagg
agctgcaggagcaaaggagaaggtggcaggcatagaatcccacagcgagctccagataagccggcagcagaacaaacta
gctgagctccatgccaacctggccagagcactccagcaggtccaagagaaggaagtcagggcccagaagcttgcagatga
cctctccactctgcaggaaaagatggctgccaccagcaaagaggtggcccgcttggagaccttggtgcgcaaggcaggtg
agcagcaggaaacagcctcccgggagttagtcaaggagcctgcgagggcaggagacagacagcccgagtggctggaagag
caacagggacgccagttctgcagcacacaggcagcgctgcaggctatggagcggggaggcagagcagatgggcaatgagct
ggaacggctgcgggccgcgctgatggagagccaggggcagcagcaggaggagcgtgggcagcaggaagggaggtggcgc
ggctgacccaggagcggggccgtgcccaggctgaccttgccctggagaaggcggccagagcagagcttgagatgcggctg
cagaacgccctcaacgagcagcgtgtggagttcgctaccctgcaagaggcactggctcatgccctgacggaaaaggaagg
caaggaccaggagttggccaagcttcgtggtctggaggcagcccagataaaagagctggaggaacttcggcaaaccgtga
agcaactgaaggaacagctggctaagaaagaaaaggagcacgcatctggctcaggagcccaatctgaggctgctggcagg
acagagccaacaggccccaagctggaagcactgcgggcagaggtgagcaagctggaacagcaatgccagaagcagcagga
gcaggctgacagcctggaacgcagcctcgaggctgagcgggcctcccgggctgagcgggacagtgctctggagactctgc

FIGURE 9-B

```
agggccagttagaggagaaggcccaggagctagggcacagtcagagtgccttagcctcggcccaacgggagttggctgcc
ttccgcaccaaggtacaagaccacagcaaggctgaagatgagtggaaggcccaggtggcccggggccggcaagaggctga
gaggaaaaatagcctcatcagcagcttggaggaggaggtgtccatcctgaatcgccaggtcctggagaaggaggggaga
gcaaggagttgaagcggctggtgatggccgagtcagagaagagccagaagctggaggagagctgcgcctgctgcaggcag
agacagccagcaacagtgccagagctgcagaacgcagctctgctctgcggaggaggtgcagagcctccgggagggaggc
tgagaaacagcgggtggcttcagagaacctgcggcaggagctgacctcacaggctgagcgtgcggaggagctgggccaag
aattgaaggcgtggcaggagaagttcttccagaaagagcaggccctctccaccctgcagctcgagcacaccagcacacag
gccctggtgagtgagctgctgccagctaagcacctctgccagcagctgcaggccgagcaggccgctgccgagaaacgcca
ccgtgaggagctggagcagagcaagcaggccgctggggactgcgggcagagctgctgcgggcccagcgggagcttgggg
agctgattcctctgcggcagaaggtggcagagcaggagcgaacagctcagcagctgcgggcagagaaggccagctatgca
gagcagctgagcatgctgaagaaggcgcatggcctgctggcagaggagaaccggggctgggtgagcgggccaaccttgg
ccggcagtttctggaagtggagttggaccaggcccgggaaaagtatgtccaagagttggcagccgtacgtgctgatgctg
agacccgtctggctgaggtgcagcgagaagcacagagcactgcccgggagctggaggtgatgactgccaagtatgagggt
gccaaggtcaaggtcctggaggagaggcagcggttccaggaagagaggcagaaactcactgcccaggtggaagaactgag
taagaaactggctgactctgaccaagccagcaaggtgcagcagcagaagctgaaggctgtccaggctcagggaggcgaga
gccagcaggaggcccagcgcttccaggcccagctgaatgaactgcaagcccagttgagccagaaggagcaggcagctgag
cactataagctgcagatggagaaagccaaaacacattatgatgccaagaagcagcagaaccaagagctgcaggagcagct
gcggagcctggagcagctgcagaaggaaaacaaagagctgcgagctgaagctgaacggctgggccatgagctacagcagg
ctgggctgaagaccaaggaggctgaacagacctgccgccaccttactgcccaggtgcgcagcctggaggcacaggttgcc
catgcagaccagcagcttcgagacctgggcaaattccaggtggcaactgatgcttttaaagagccgtgagccccaggctaa
gccccagctggacttgagtattgacagcctggatctgagctgcgaggagggggaccccactcagtatcaccagcaagctgc
ctcgtacccagccagacggcaccagcgtccctggagaaccagcctcacctatctcccagcgcctgccccccaaggtagaa
tccctggagagtctctacttcactcccatccctgctcggagtcaggcccccctggagagcagcctggactccctgggaga
cgtcttcctggactcgggtcgtaagacccgctccgctcgtcggcgcaccacgcagatcatcaacatcaccatgaccaaga
agctagatgtggaagagccagacagcgccaactcatcgttctacagcacgcggtctgctcctgcttcccaggctagcctg
cgagccacctcctctactcagtctctagctcgcctgggttctcccgattatggcaactcagccctgctcagcttgcctgg
ctaccgcccaccactcgcagttctgctcgtcgttcccaggccggggtgtccagtggggcccctccaggaaggaacagct
tctacatgggcacttgccaggatgagcctgagcagctggatgactggaaccgcattgcagagctgcagcagcgcaatcga
gtgtgcccccacatctgaagacctgctatcccctggagtccaggccttccctgagcctgggcaccatcacagatgagga
gatgaaaactggagaccccaagagaccctgcgccgagccagcatgcagccaatccagatagccgagggcactggcatca
ccacccggcagcagcgcaaacgggtctccctagagccccaccagggccctggaactcctgagtctaagaaggccaccagc
tgtttcccacgcccatgactccccgagaccgacatgaaggggcgcaaacagagcactactgaggcccagaagaaagcagc
tccagcttctactaaacaggctgaccggcgccagtcgatggccttcagcatcctcaacacacccaagaagctagggaaca
gccttctgcggcggggagcctcaaagaaggccctgtccaaggcttccccaacactcgcagtggaacccgccgttctccg
cgcattgccaccaccacagccagtgccgccactgctgccgccattggtgccacccctcgagccaagggcaaggcaaagca
ctaaagggccagtaccagtgagtggccccacctgtgtcccgatgctgccgtcacctggtcctccgcctactgtccctct
cagtgccttctctcagctcccaggccaacagtagccaaaccctagagacagtgatgcctgcccgcaccctggcctggcc
cctggtccttcactggcgccttctcggagctggcccaggggggcctggagcatggacagtgtgggcgctctccctaccttg
cctcctttttttcttaaagcaaagtcacttctccatcacaaccagatttgaggctggttttgatggctgggtccttgggcc
tggccagtcttcctcttagcctctggatctagaagggaccataagaggagtaggccctggttcctgctgtcctggtggct
gggccagcagggggccctcactcttgaagtccaggactgggtctgacctggtgggagcacctgccagaggatgctctttcc
caggacggatgggccctgtgtctcaggagtgggttggggggacagccttcagcagcagctcacaccctaccttccccaga
cttgcactgggtgtggatttggagtgatgggaaggttttaagggccggggatggatcttttctaaatgttattacttgt
aaataaagtctattttt
```

FIGURE 10A

NP_000192 [gi:4557878] intercellular adhesion molecule 1 precursor; CD54 [Homo sapiens]

MAPSSPRPALPALLVLLGALFPGPGNAQTSVSPSKVILPRGGSVLVTCSTSCDQPK
LLGIETPLPKKELLLPGNNRKVYELSNVQEDSQPMCYSNCPDGQSTAKTFLTVY
WTPERVELAPLPSWQPVGKNLTLRCQVEGGAPRANLTVVLLRGEKELKREPAV
GEPAEVTTTVLVRRDHHGANFSCRTELDLRPQGLELFENTSAPYQLQTFVLPATP
PQLVSPRVLEVDTQGTVVCSLDGLFPVSEAQVHLALGDQRLNPTVTYGNDSFSA
KASVSVTAEDEGTQRLTCAVILGNQSQETLQTVTIYSFPAPNVILTKPEVSEGTEV
TVKCEAHPRAKVTLNGVPAQPLGPRAQLLLKATPEDNGRSFSCSATLEVAGQLI
HKNQTRELRVLYGPRLDERDCPGNWTWPENSQQTPMCQAWGNPLPELKCLKD
GTFPLPIGESVTVTRDLEGTYLCRARSTQGEVTREVTVNVLSPRYEIVIITVVAAA
VIMGTAGLSTYLYNRQRKIKKYRLQQAQKGTPMKPNTQATPP

FIGURE 10B

NP_001535 [gi:4504561] intercellular adhesion molecule 4 isoform 1 precursor; Landsteiner-Wiener blood group protein [Homo sapiens].

MGSLFPLSLLFFLAAAYPGVGSALGRRTKRAQSPKGSPLAPSGTSVPFWVRMSPE
FVAVQPGKSVQLNCSNSCPQPQNSSLRTPLRQGKTLRGPGWVSYQLLDVRAWSS
LAHCLVTCAGKTRWATSRITAYKPPHSVILEPPVLKGRKYTLRCHVTQVFPVGY
LVVTLRHGSRVIYSESLERFTGLDLANVTLTYEFAAGPRDFWQPVICHARLNLDG
LVVRNSSAPITLMLAWSPAPTALASGSIAALVGILLTVGAAYLCKCLAMKSQA

FIGURE 10C

NP_003250 [gi:12545404] intercellular adhesion molecule 5 precursor; telencephalin [Homo sapiens].

MPGPSPGLRRALLGLWAALGLGLFGLSAVSQEPFWADLQPRVAFVERGGSLWL
NCSTNCPRPERGGLETSLRRNGTQRGLRWLARQLVDIREPETQPVCFFRCARRTL
QARGLIRTFQRPDRVELMPLPPWQPVGENFTLSCRVPGAGPRASLTLTLLRGAQE
LIRRSFAGEPPRARGAVLTATVLARREDHGANFSCRAELDLRPHGLGLFENSSAP
RELRTFSLSPDAPRLAAPRLLEVGSERPVSCTLDGLFPASEARVYLALGDQNLSPD
VTLEGDAFVATATATASAEQEGARQLICNVTLGGENRETRENVTIYSFPAPLLTL
SEPSVSEGQMVTVTCAAGTQALVTLEGVPAAVPGQPAQLQLNATENDDRRSFFC
DATLDVDGETLIKNRSAELRVLYAPRLDDSDCPRSWTWPEGPEQTLRCEARGNP
EPSVHCARSDGGAVLALGLLGPVTRALSGTYRCKAANDQGEAVKDVTLTVEYA
PALDSVGCPERITWLEGTEASLSCVAHGVPPPDVICVRSGELGAVIEGLLRVARE
HAGTYRCEATNPRGSAAKNVAVTVEYGPRFEEPSCPSNWTWVEGSGRLFSCEV
DGKPQPSVKCVGSGGATEGVLLPLAPPDPSPRAPRIPRVLAPGIYVCNATNRHGS
VAKTVVVSAESPPEMDESTCPSHQTWLEGAEASALACAARGRPSPGVRCSREGIP
WPEQQRVSREDAGTYHCVATNAHGTDSRTVTVGVEYRPVVAELAASPPGGVRP
GGNFTLTCRAEAWPPAQISWRAPPGALNIGLSSNNSTLSVAGAMGSHGGEYECA
RTNAHGRHARRITVRVAGPWLWVAVGGAAGGAALLAAGAGLAFYVQSTACKK
GEYNVQEAESSGEAVCLNGAGGGAGGAAGAEGGPEAAGGAAESPAEGEVFAIQ
LTSA

FIGURE 11

NP_002744 [gi:4506081] mitogen-activated protein kinase 10 isoform 1;
JNK3 alpha protein kinase; stress activated protein kinase beta; MAP
kinase; c-Jun kinase 3; c-Jun N-terminal kinase 3; stress activated
protein kinase JNK3 [Homo sapiens].

MSLHFLYYCSEPTLDVKIAFCQGFDKQVDVSYIAKHYNMSKSKVDNQFYSVEVG
DSTFTVLKRYQNLKPIGSGAQGIVCAAYDAVLDRNVAIKKLSRPFQNQTHAKRA
YRELVLMKCVNHKNIISLLNVFTPQKTLEEFQDVYLVMELMDANLCQVIQMELD
HERMSYLLYQMLCGIKHLHSAGIIHRDLKPSNIVVKSDCTLKILDFGLARTAGTSF
MMTPYVVTRYYRAPEVILGMGYKENVDIWSVGCIMGEMVRHKILFPGRDYIDQ
WNKVIEQLGTPCPEFMKKLQPTVRNYVENRPKYAGLTFPKLFPDSLFPADSEHN
KLKASQARDLLSKMLVIDPAKRISVDDALQHPYINVWYDPAEVEAPPPQIYDKQ
LDEREHTIEEWKELIYKEVMNSEEKTKNGVVKGQPSPSAQVQQ

Additional isoforms are isoform 2 (NP_620448); isoform 3 (NP_620446); isoform 4 (NP_620447)

FIGURE 12

NP_055893: KIAA0861

MLSCLKEEMPPQELTRRLATVITHVDEIMQQEVRPLMAVEIIEQLHRQFAILSGGR
GEDGAPIITFPEFSGFKHIPDEDFLNVMTYLTSIPSVEAASIGFIVVIDRRRDKWSSV
KASLTRIAVAFPGNLQLIFILRPSRFIQRTFTDIGIKYYRNEFKTKVPIIMVNSVSDL
HGYIDKSQLTRELGGTLEYRHGQWVNHRTAIENFALTLKTTAQMLQTFGSCLAT
AELPRSMLSTEDLLMSHTRQRDKLQDELKLLGKQGTTLLSCIQEPATKCPNSKLN
LNQLENVTTMERLLVQLDETEKAFSHFWSEHHLKLNQCLQLQHFEHDFCKAKL
ALDNLLEEQAEFTGIGDSVMHVEQILKEHKKLEEKSQEPLEKAQLLALVGDQLIQ
SHHYAADAIRPRCVELRHLCDDFINGNKKKWDILGKSLEFHRQLDKVSQWCEAG
IYLLASQAVDKCQSREGVDIALNDIATFLGTVKEYPLLSPKEFYNEFELLLTLDAK
AKAQKVLQRLDDVQEIFHKRQVSLMKLAAKQTRPVQPVAPHPESSPKWVSSKTS
QPSTSVPLARPLRTSEEPYTETELNSRGKEDDETKFEVKSEEIFESHHERGNPELEQ
QARLGDLSPRRRIIRDLLETEEIYIKEIKSIIDGYITPMDFIWLKHLIPDVLQNNKDF
LFGNIRELYEFHNRTFLKELEKCAENPELLAHCFLKRKEDLQIYFKYHKNLPRAR
AIWQECQDCAYFGVCQRQLDHNLPLFKYLKGPSQRLIKYQMLLKGLLDFESPED
MEIDPGELGGSAKDGPKRTKDSAFSTELQQALAVIEDLIKSCELAVDLAAVTECP
DDIGKLGKLLLHGPFSVWTIHKDRYKMKDLIRFKPSQRQIYLFERGIVFCKIRMEP
GDQGLSPHYSFKKTMKLMTLSIRQLGRGSHRKFEIASRNGLEKYILQAASKEIRD
CWFSEISKLLMEQQNNIKDQGNPQFEMSTSKGSGAGSPWIKNMERATTSKEDP
ASSTGGIKGCSSREFSSMDTFEDCEGAEDMEKESSALSLAGLFQSDDSHETCSSKS
AFLERGESSQGEKEERDEEETATRSTEEERAGASTGRLAPAGATAGFQARALRPR
TSAQES

FIGURE 13

NP_006176 [gi: 5453820] nuclear mitotic apparatus protein 1 [Homo sapiens].

MTLHATRGAALLSWVNSLHVADPVEAVLQLQDCSIFIKIIDRIHGTEEGQQILKQP
VSERLDFVCSFLQKNRKHPSSPECLVSAQKVLEGSELELAKMTMLLLYHSTMSS
KSPRDWEQFEYKIQAELAVILKFVLDHEDGLNLNEDLENFLQKAPVPSTCSSTFP
EELSPPSHQAKREIRFLELQKVASSSGNNFLSGSPASPMGDILQTPQFQMRRLKK
QLADERSNRDELELELAENRKLLTEKDAQIAMMQQRIDRLALLNEKQAASPLEP
KELEELRDKNESLTMRLHETLKQCQDLKTEKSQMDRKINQLSEENGDLSFKLRE
FASHLQQLQDALNELTEEHSKATQEWLEKQAQLEKELSAALQDKKCLEEKNEIL
QGKLSQLEEHLSQLQDNPPQEKGEVLGDVLQLETLKQEAATLAANNTQLQARV
EMLETERGQQEAKLLAERGHFEEEKQQLSSLITDLQSSISNLSQAKEELEQASQA
HGARLTAQVASLTSELTTLNATIQQQDQELAGLKQQAKEKQAQLAQTLQQQEQ
ASQGLRHQVEQLSSSLKQKEQQLKEVAEKQEATRQDHAQQLATAAEEREASLR
ERDAALKQLEALEKEKAAKLEILQQQLQVANEARDSAQTSVTQAQREKAELSRK
VEELQACVETARQEQHEAQAQVAELELQLRSEQQKATEKERVAQEKDQLQEQL
QALKESLKVTKGSLEEEKRRAADALEEQQRCISELKAETRSLVEQHKRERKELEE
ERAGRKGLEARLLQLGEAHQAETEVLRRELAEAMAAQHTAESECEQLVKEVAA
WRDGYEDSQQEEAQYGAMFQEQLMTLKEECEKARQELQEAKEKVAGIESHSEL
QISRQQNKLAELHANLARALQQVQEKEVRAQKLADDLSTLQEKMAATSKEVAR
LETLVRKAGEQQETASRELVKEPARAGDRQPEWLEEQQGRQFCSTQAALQAME
REAEQMGNELERLRAALMESQGQQQEERGQQEREVARLTQERGRAQADLALEK
AARAELEMRLQNALNEQRVEFATLQEALAHALTEKEGKDQELAKLRGLEAAQI
KELEELRQTVKQLKEQLAKKEKEHASGSGAQSEAAGRTEPTGPKLEALRAEVSK
LEQQCQKQQEQADSLERSLEAERASRAERDSALETLQGQLEEKAQELGHSQSAL
ASAQRELAAFRTKVQDHSKAEDEWKAQVARGRQEAERKNSLISSLEEEVSILNR
QVLEKEGESKELKRLVMAESEKSQKLEESCACCRQRQPATVPELQNAALLCGRR
CRASGREAEKQRVASENLRQELTSQAERAEELGQELKAWQEKFFQKEQALSTLQ
LEHTSTQALVSELLPAKHLCQQLQAEQAAAEKRHREELEQSKQAAGGLRAELLR
AQRELGELIPLRQKVAEQERTAQQLRAEKASYAEQLSMLKKAHGLLAEENRGLG
ERANLGRQFLEVELDQAREKYVQELAAVRADAETRLAEVQREAQSTARELEVM
TAKYEGAKVKVLEERQRFQEERQKLTAQVEELSKKLADSDQASKVQQQKLKAV
QAQGGESQQEAQRFQAQLNELQAQLSQKEQAAEHYKLQMEKAKTHYDAKKQQ
NQELQEQLRSLEQLQKENKELRAEAERLGHELQQAGLKTKEAEQTCRHLTAQV
RSLEAQVAHADQQLRDLGKFQVATDALKSREPQAKPQLDLSIDSLDLSCEEGTPL
SITSKLPRTQPDGTSVPGEPASPISQRLPPKVESLESLYFTPIPARSQAPLESSLDSLG
DVFLDSGRKTRSARRRTTQIINITMTKKLDVEEPDSANSSFYSTRSAPASQASLRA
TSSTQSLARLGSPDYGNSALLSLPGYRPTTRSSARRSQAGVSSGAPPGRNSFYMG
TCQDEPEQLDDWNRIAELQQRNRVCPPHLKTCYPLESRPSLSLGTITDEEMKTGD
PQETLRRASMQPIQIAEGTGITTRQQRKRVSLEPHQGPGTPESKKATSCFPRPMTP
RDRHEGRKQSTTEAQKKAAPASTKQADRRQSMAFSILNTPKKLGNSLLRRGASK
KALSKASPNTRSGTRRSPRIATTTASAATAAAIGATPRAKGKAKH

MAPK10

KIAA0861

ICAM region Meta Analysis

MAPK10 Meta Analysis

NUMA1/LOC220074/FLJ20625 Meta Analysis

METHODS FOR IDENTIFYING RISK OF BREAST CANCER AND TREATMENTS THEREOF

RELATED PATENT APPLICATIONS

This patent application claims the benefit of provisional patent application No. 60/429,136 filed Nov. 25, 2002 and provisional patent application No. 60/490,234 filed Jul. 24, 2003, having and, respectively. Each of these provisional patent applications names Richard B. Roth et al. as inventors and is hereby incorporated herein by reference in its entirety, including all drawings and cited publications and documents. Also incorporated by reference are patent applications concurrently filed on Nov. 25, 2003, the day this application is filed, entitled "Methods for identifying risk of breast cancer and treatments thereof," naming Richard B. Roth et al. as inventors and bearing and. In addition, incorporated by reference is a concurrently filed patent application naming Matthew R. Nelson as an inventor, entitled "Disease risk prediction with associated single nucleotide polymorphisms".

Sequence Listing

The instant application contains a "lengthy" Sequence Listing which has been submitted via CD-R in lieu of a printed paper copy, and is hereby incorporated by reference in its entirety. Said CD-R, recorded on Oct. 11, 2004, are labeled "Copy 1" and "Copy 2", respectively, and each contains only one identical 740 Kb file (SEQ469CP.APP).

FIELD OF THE INVENTION

The invention relates to genetic methods for identifying risk of breast cancer and treatments that specifically target the disease.

BACKGROUND

Breast cancer is the third most common cancer, and the most common cancer in women, as well as a cause of disability, psychological trauma, and economic loss. Breast cancer is the second most common cause of cancer death in women in the United States, in particular for women between the ages of 15 and 54, and the leading cause of cancer-related death (Forbes, Seminars in Oncology, vol. 24(1), Suppl 1, 1997: pp.S1-20-S1-35). Indirect effects of the disease also contribute to the mortality from breast cancer including consequences of advanced disease, such as metastases to the bone or brain. Complications arising from bone marrow suppression, radiation fibrosis and neutropenic sepsis, collateral effects from therapeutic interventions, such as surgery, radiation, chemotherapy, or bone marrow transplantation-also contribute to the morbidity and mortality from this disease.

While the pathogenesis of breast cancer is unclear, transformation of normal breast epithelium to a malignant phenotype may be the result of genetic factors, especially in women under thirty (Miki, et al., Science, 266: 66-71 (1994)). However, it is likely that other, non-genetic factors also have a significant effect on the etiology of the disease. Regardless of its origin, breast cancer morbidity increases significantly if it is not detected early in its progression. Thus, considerable efforts have focused on the elucidation of early cellular events surrounding transformation in breast tissue. Such efforts have led to the identification of several potential breast cancer markers. For example, alleles of the BRCA1 and BRCA2 genes have been linked to hereditary and early-onset breast cancer (Wooster, et al., Science, 265: 2088-2090 (1994)). However, BRCA1 is limited as a cancer marker because BRCA1 mutations fail to account for the majority of breast cancers (Ford, et al., British J. Cancer, 72: 805-812 (1995)). Similarly, the BRCA2 gene, which has been linked to forms of hereditary breast cancer, accounts for only a small portion of total breast cancer cases.

SUMMARY

It has been discovered that certain polymorphic variations in human genomic DNA are associated with the occurrence of breast cancer. In particular, polymorphic variants in loci containing ICAM, MAPK10, KIAA0861, NUMA1/FLJ20625/LOC220074 (hereafter referred to as "NUMA1"), and HT014/LOC148902/LYPLA2/GALE (hereafter refered to as "GALE") regions in human genomic DNA have been associated with risk of breast cancer.

Thus, featured herein are methods for identifying a subject at risk of breast cancer and/or a risk of breast cancer in a subject, which comprises detecting the presence or absence of one or more polymorphic variations accociated with breast cancer in genomic regions described herein in a human nucleic acid sample. In an embodiment, two or more polymorphic variations are detected in two or more regions selected from the group consisting of ICAM, MAPK10, KIAA0861, NUMA1 and GALE. In certain embodiments, 3 or more, or 4, 5, 6, 7, 8, 9, 10, 11, 12, 13, 14, 15, 16, 17, 18, 19 or 20 or more polymorphic variants are detected. In specific embodiments, the group of polymorphic variants detected comprise or consist of polymorphic variants in ICAM, MAPK10, KIAA0861, NUMA1 and GALE, such as position 44247 in SEQ ID NO: 1 (ICAM), position 36424 in SEQ ID NO: 2 (MAPK10), position 48563 in SEQ ID NO: 3 (KIAA0861), position 49002 in SEQ ID NO: 4 (NUMA1) and position 174 in SEQ ID NO: 5 (GALE), for example.

Also featured are nucleic acids that include one or more polymorphic variations associated with the occurrence of breast cancer, as well as polypeptides encoded by these nucleic acids. Further, provided is a method for identifying a subject at risk of breast cancer and then prescribing to the subject a breast cancer detection procedure, prevention procedure and/or a treatment procedure. In addition, provided are methods for identifying candidate therapeutic molecules for treating breast cancer and related disorders, as well as methods for treating breast cancer in a subject by diagnosing breast cancer in the subject and treating the subject with a suitable treatment, such as administering a therapeutic molecule.

Also provided are compositions comprising a breast cancer cell and/or ICAM, MAPK10, KIAA0861, NUMA1 or GALE nucleic acid with a RNAi, siRNA, antisense DNA or RNA, or ribozyme nucleic acid designed from a ICAM, MAPK10, KIAA0861, NUMA1 or GALE nucleotide sequence. In an embodiment, the nucleic acid is designed from a ICAM, MAPK10, KIAA0861, NUMA1 or GALE nucleotide sequence that includes one or more breast cancer associated polymorphic variations, and in some instances, specifically interacts with such a nucleotide sequence. Further, provided are arrays of nucleic acids bound to a solid surface, in which one or more nucleic acid molecules of the array have a ICAM, MAPK10, KIAA0861, NUMA1 or GALE nucleotide sequence, or a fragment or substantially identical nucleic acid thereof, or a complementary nucleic acid of the foregoing. Featured also are compositions comprising a breast cancer cell and/or a ICAM, MAPK10, KIAA0861, NUMA1 or GALE polypeptide, with an antibody that specifically binds to the polypeptide. In an embodiment, the antibody specifically binds to an epitope in the polypeptide that includes a non-synonymous amino acid modification associated with breast cancer (e.g., results in an amino acid substitution in the encoded polypeptide associated with breast cancer). In certain embodiments, the antibody specifically binds to an epitope that comprises a proline at amino acid position 352 or an alanine at amino acid position 348 in an ICAM5 polypeptide.

BRIEF DESCRIPTION OF THE FIGURES

FIGS. 1A-1Y show a genomic nucleotide sequence for an ICAM region encoding ICAM1, 4 and 5. The genomic nucleotide sequence is set forth in SEQ ID NO: 1. The following nucleotide representations are used throughout: "A" or "a" is adenosine, adenine, or adenylic acid; "C" or "c" is cytidine, cytosine, or cytidylic acid; "G" or "g" is guanosine, guanine, or guanylic acid; "T" or "t" is thymidine, thymine, or thymidylic acid; and "I" or "i" is inosine, hypoxanthine, or inosinic acid. Exons are indicated in italicized lower case type, introns are depicted in normal text lower case type, and polymorphic sites are depicted in bold upper case type. SNPs are designated by the following convention: "R" represents A or G, "M" represents A or C; "W" represents A or T; "Y" represents C or T; "S" represents C or G; "K" represents G or T; "V" represents A, C or G; "H" represents A, C, or T; "D" represents A, G, or T; "B" represents C, G, or T; and "N" represents A, G, C, or T.

FIGS. 2A-2U show a genomic nucleotide sequence of a MAPK10 region. The genomic nucleotide sequence is set forth in SEQ ID NO: 2.

FIGS. 3A-3NN show a genomic nucleotide sequence of a KIAA0861 region. The genomic nucleotide sequence is set forth in SEQ ID NO: 3.

FIGS. 4A-4JJ show a genomic nucleotide sequence of a NUMA1/FLJ20625/LOC220074 region, referred to herein as the NUMA1 region. The genomic nucleotide sequence is set forth in SEQ ID NO: 4.

FIG. 5 shows a portion of a genomic nucleotide sequence of a HT014/LOC148902/LYPLA2/GALE region, referred to herein as the GALE region. The genomic nucleotide sequence is set forth in SEQ ID NO: 5.

FIGS. 6A-6C show coding nucleotide sequences (cDNA) for ICAM1, ICAM4 and ICAM5, respectively. The nucleotide sequences are set forth in SEQ ID NOs: 6, 7 and 8, respectively.

FIG. 7 shows a coding nucleotide sequence (cDNA) for MAPK10. The nucleotide sequence is set forth in SEQ ID NO: 9.

FIGS. 8A-8B show coding nucleotide sequences (cDNA) for KIAA0861. The nucleotide sequences are set forth in SEQ ID NO: 10 and 11, respectively.

FIGS. 9A-9B show a coding nucleotide sequence (cDNA) for NUMA1. The nucleotide sequence is set forth in SEQ ID NO: 12.

FIGS. 10A-10C show amino acid sequences for ICAM1, ICAM4 and ICAM5 polypeptides. The amino acid sequences are set forth in SEQ ID NOs: 13, 14 and 15, respectively.

FIG. 11 shows an amino acid sequence for a MAPK10 polypeptide, which is set forth in SEQ ID NO: 16.

FIG. 12 shows an amino acid sequence for a KIAA0861 polypeptide, which is set forth in SEQ ID NO: 17.

FIG. 13 shows an amino acid sequence for a NUMA1 polypeptide, which is set forth in SEQ ID NO: 18.

DETAILED DESCRIPTION

Figure 14:
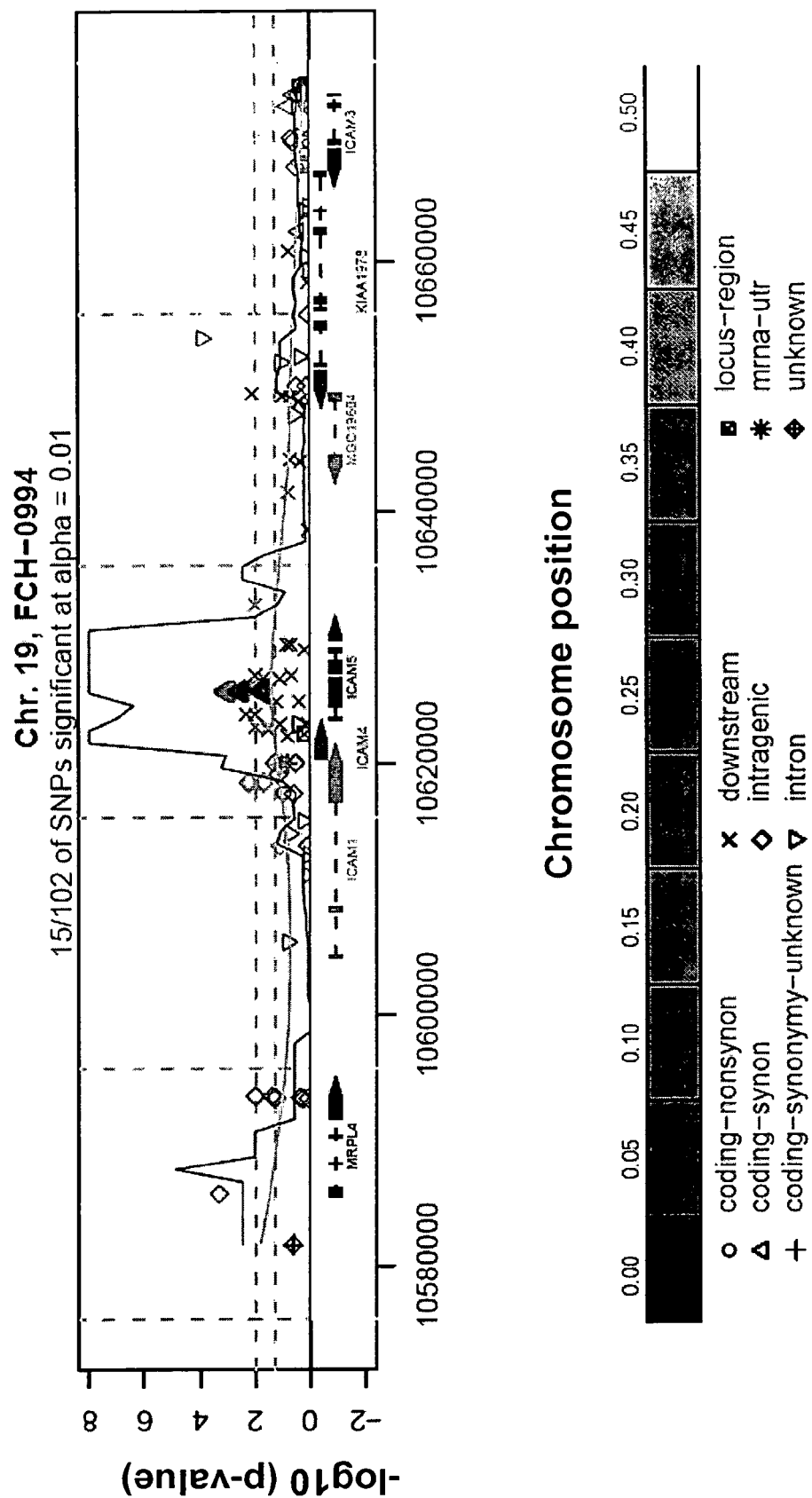
FIG. 14 shows proximal SNPs in the ICAM region in genomic DNA. The position of each SNP on the chromosome is shown on the x-axis and the y-axis provides the negative logarithm of the p-value comparing the estimated allele to that of the control group. Also shown in the figure are exons and introns of the genes in the approximate chromosomal positions. The figure indicates that polymorphic variants associated with breast cancer are in linkage disequilibrium in a region spanning positions 11851-24282, 36340-37868, 41213-41613, 70875-74228, 42407-45536, or 42407-51102 in SEQ ID NO: 1.
Figure 15:
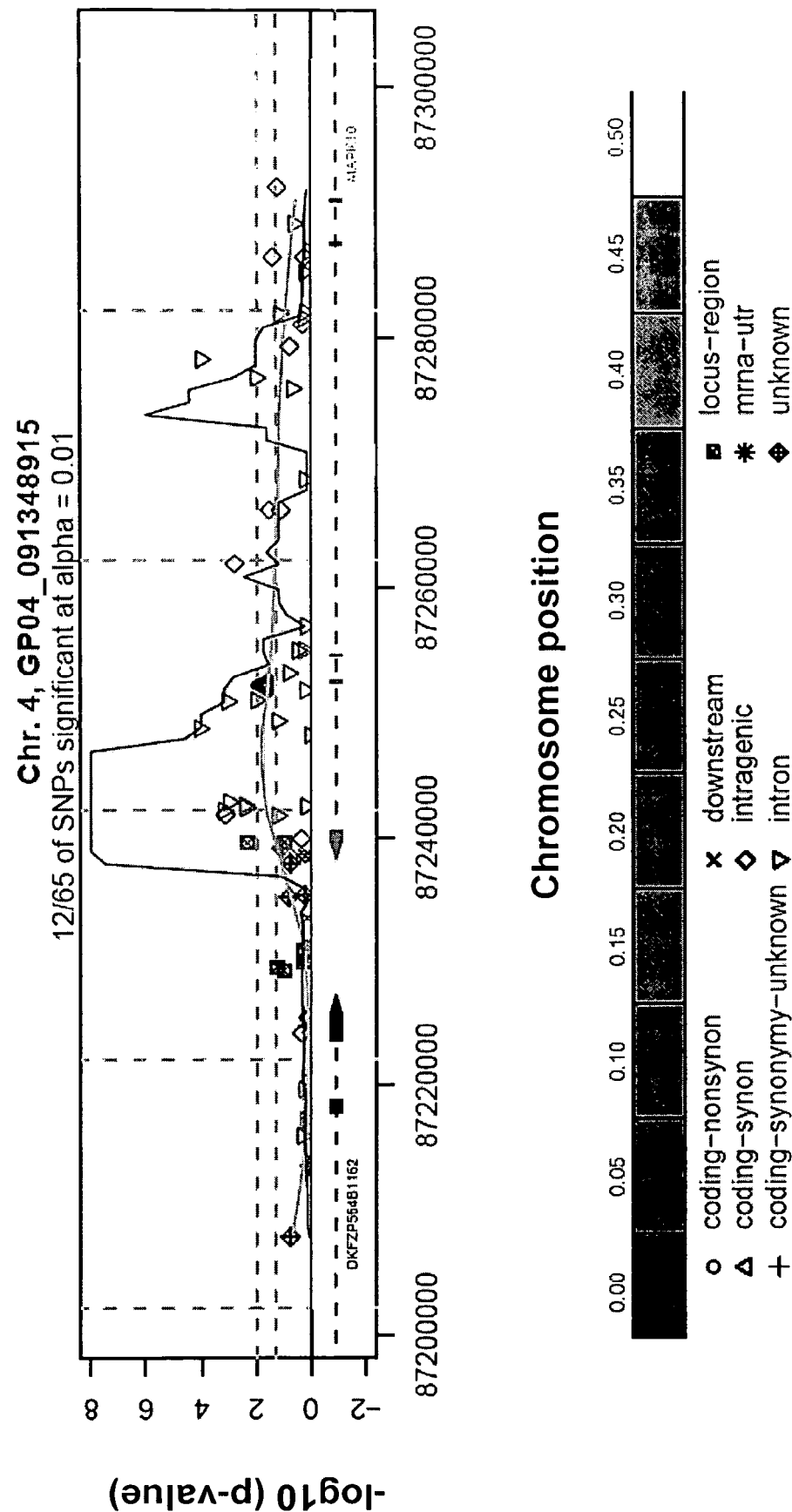
FIG. 15 shows proximal SNPs in the MAPK10 region in genomic DNA. The position of each SNP on the chromosome is shown on the x-axis and the y-axis provides the negative logarithm of the p-value comparing the estimated allele to that of the control group. Also shown in the figure are exons and introns of the genes in the approximate chromosomal positions. The figure indicates that polymorphic variants associated with breast cancer are in linkage disequilibrium in a region spanning positions 23826-36424, 46176-62572, 4512-8467 or 13787-14355 in SEQ ID NO: 2.

It has been discovered that polymorphic variations in the ICAM, MAPK10, KIAA0861, NUMA1 and GALE regions described herein are associated with an increased risk of breast cancer.

All ICAM proteins are type I transmembrane glycoproteins, contain 2-9 immunoglobulin-like C2-type domains, and bind to the leukocyte adhesion LFA-1 protein. The proteins are members of the intercellular adhesion molecule (ICAM) family. The gene ICAM1 (intercellular adhesion molecule-1) is also known as human rhinovirus receptor, BB2, CD54. and cell surface glycoprotein P3.58. ICAM1 has been mapped to chromosomal position 19p13.3-p13.2. ICAM1 (CD54) typically is expressed on endothelial cells and cells of the immune system. ICAM1 binds to integrins of type CD11a/CD18, or CD11b/CD18. ICAM1 is also exploited by Rhinovirus as a receptor.

The gene ICAM4 (intercellular adhesion molecule 4) is also known as the Landsteiner-Wiener blood group or LW. ICAM4 has been mapped to 19p13.2-cen. The protein encoded by this gene is a member of the intercellular adhesion molecule (ICAM) family. A glutamine to arginine polymorphism in this protein is responsible for the Landsteiner-Wiener blood group system (GLN=WB(A); ARG=WB(B). This gene consists of 3 exons and alternative splicing generates 2 transcript variants.

The gene ICAM5 (intercellular adhesion molecule 5) is also known as telencephalin. ICAM5 has been mapped to 19p13.2. The protein encoded by the gene is expressed on the surface of telencephalic neurons and displays two types of adhesion activity, homophilic binding between neurons and heterophilic binding between neurons and leukocytes. It may be a critical component in neuron-microglial cell interactions in the course of normal development or as part of neurodegenerative diseases.

The gene MAPK10 also is known as JNK3, JNK3A, PRKM10, p493F12, FLJ12099, p54bSAPK MAP kinase, c-Jun kinase 3, JNK3 alpha protein kinase, c-Jun N-terminal kinase 3, stress activated protein kinase JNK3, stress activated protein kinase beta. MAPK10 has been mapped to chromosomal position 4q22.1-q23. The protein encoded by this gene is a member of the MAP kinase family. MAP kinases act as an integration point for multiple biochemical signals, and are involved in a wide variety of cellular processes such as proliferation, differentiation, transcription regulation and development. This protein is a neuronal-specific form of c-Jun N-terminal kinases (JNKs). Through its phosphorylation and nuclear localization, this kinase plays regulatory roles in the signaling pathways during neuronal apoptosis. Beta-arrestin 2, a receptor-regulated MAP kinase scaffold protein, is found to interact with, and stimulate the phosphorylation of this kinase by MAP kinase kinase 4 (MKK4). Cyclin-dependent kinase 5 can phosphorylate, and inhibit the activity of this kinase, which may be important in preventing neuronal apoptosis. Four alternatively spliced transcript variants encoding distinct isoforms have been reported.

The gene KIAA0861 is a Rho family guanine-nucleotide exchange factor. KIAA0861 has been mapped to chromosomal position 3q27.3. KIAA0861 is a Rho family nucleotide exchange factor homolog that modulates the activity of Rho family GTPases, which control numerous cell functions, including cell growth, adhesion, movement and shape. RhoC GTPase is overexpressed in invasive (inflammatory) breast cancers.

The gene FLJ20625 has been mapped to chromosomal position 11q13.3. The gene encoding LOC220074 also is known as Hypothetical 55.1 kDa protein F09G8.5 in chromosome III and has been mapped to chromosomal position 11q13.3.

The gene HT014 has been mapped to chromosomal position 1p36.11. The gene LYPLA2 (lysophospholipase II) also is known as APT-2, DJ886K2.4 and acyl-protein thioesterase and has been mapped to chromosomal position 1p36.12-p35.1. Lysophospholipases are enzymes that act on biological membranes to regulate the multifunctional lysophospholipids. There are alternatively spliced transcript variants described for this gene but the full length nature is not known yet.

The gene GALE (galactose-4-epimerase, UDP-) also is known as galactowaldenase UDP galactose-4-epimerase and has been mapped to chromosomal position 1p36-p35. This gene encodes UDP-galactose-4-epimerase which catalyzes 2 distinct but analogous reactions: the epimerization of UDP-glucose to UDP-galactose, and the epimerization of UDP-N-acetylglucosamine to UDP-N-acetylgalactosamine. The bifunctional nature of the enzyme has the important metabolic consequence that mutant cells (or individuals) are dependent not only on exogenous galactose, but also on exogenous N-acetylgalactosamine for necessary precursor for the synthesis of glycoproteins and glycolipids. The missense mutations in the GALE gene result in the epimerase-deficiency galactosemia.

Breast Cancer and Sample Selection

Breast cancer is typically described as the uncontrolled growth of malignant breast tissue. Breast cancers arise most commonly in the lining of the milk ducts of the breast (ductal carcinoma), or in the lobules where breast milk is produced (lobular carcinoma). Other forms of breast cancer include Inflammatory Breast Cancer and Recurrent Breast Cancer. Inflammatory breast cancer is a rare, but very serious, aggressive type of breast cancer. The breast may look red and feel warm with ridges, welts, or hives on the breast; or the skin may look wrinkled. It is sometimes misdiagnosed as a simple infection. Recurrent disease means that the cancer has come back after it has been treated. It may come back in the breast, in the soft tissues of the chest (the chest wall), or in another part of the body.

As used herein, the term "breast cancer" refers to a condition characterized by anomalous rapid proliferation of abnormal cells in one or both breasts of a subject. The abnormal cells often are referred to as "neoplastic cells," which are transformed cells that can form a solid tumor. The term "tumor" refers to an abnormal mass or population of cells (i.e. two or more cells) that result from excessive or abnormal cell division, whether malignant or benign, and pre-cancerous and cancerous cells. Malignant tumors are distinguished from benign growths or tumors in that, in addition to uncontrolled cellular proliferation, they can invade surrounding tissues and can metastasize. In breast cancer, neoplastic cells may be identified in one or both breasts only and not in another tissue or organ, in one or both breasts and one or more adjacent tissues or organs (e.g. lymph node), or in a breast and one or more non-adjacent tissues or organs to which the breast cancer cells have metastasized.

The term "invasion" as used herein refers to the spread of cancerous cells to adjacent surrounding tissues. The term "invasion" often is used synonymously with the term "metastasis," which as used herein refers to a process in which cancer cells travel from one organ or tissue to another non-adjacent organ or tissue. Cancer cells in the breast(s) can spread to tissues and organs of a subject, and conversely, cancer cells from other organs or tissue can invade or metastasize to a breast. Cancerous cells from the breast(s) may invade or metastasize to any other organ or tissue of the body. Breast cancer cells often invade lymph node cells and/or metastasize to the liver, brain and/or bone and spread cancer in these tissues and organs. Breast cancers can spread to other organs and tissues and cause lung cancer, prostate cancer, colon cancer, ovarian cancer, cervical cancer, gastrointestinal cancer, pancreatic cancer, glioblastoma, bladder cancer, hepatoma, colorectal cancer, uterine cervical cancer, endometrial carcinoma, salivary gland carcinoma, kidney cancer, vulval cancer, thyroid cancer, hepatic carcinoma, skin cancer, melanoma, ovarian cancer, neuroblastoma, myeloma, various types of head and neck cancer, acute lymphoblastic leukemia, acute myeloid leukemia, Ewing sarcoma and peripheral neuroepithelioma, and other carcinomas, lymphomas, blastomas, sarcomas, and leukemias.

Breast cancers arise most commonly in the lining of the milk ducts of the breast (ductal carcinoma), or in the lobules where breast milk is produced (lobular carcinoma). Other forms of breast cancer include Inflammatory Breast Cancer and Recurrent Breast Cancer. Inflammatory Breast Cancer is a rare, but very serious, aggressive type of breast cancer. The breast may look red and feel warm with ridges, welts, or hives on the breast; or the skin may look wrinkled. It is sometimes misdiagnosed as a simple infection. Recurrent disease means that the cancer has come back after it has been treated. It may come back in the breast, in the soft tissues of the chest (the chest wall), or in another part of the body. As used herein, the term "breast cancer" may include both Inflammatory Breast Cancer and Recurrent Breast Cancer.

In an effort to detect breast cancer as early as possible, regular physical exams and screening mammograms often are prescribed and conducted. A diagnostic mammogram often is performed to evaluate a breast complaint or abnormality detected by physical exam or routine screening mammography. If an abnormality seen with diagnostic mammography is suspicious, additional breast imaging (with exams such as ultrasound) or a biopsy may be ordered. A biopsy followed by pathological (microscopic) analysis is a definitive way to determine whether a subject has breast cancer. Excised breast cancer samples often are subjected to the following analyses: diagnosis of the breast tumor and confirmation of its malignancy; maximum tumor thickness; assessment of completeness of excision of invasive and in situ components and microscopic measurements of the shortest extent of clearance; level of invasion; presence and extent of regression; presence and extent of ulceration; histological type and special variants; pre-existing lesion; mitotic rate; vascular invasion; neurotropism; cell type; tumor lymphocyte infiltration; and growth phase.

The stage of a breast cancer can be classified as a range of stages from Stage 0 to Stage IV based on its size and the extent to which it has spread. The following table summarizes the stages:

TABLE A

| Stage | Tumor Size | Lymph Node Involvement | Metastasis (Spread) |
|---|---|---|---|
| I | Less than 2 cm | No | No |
| II | Between 2-5 cm | No or in same side of breast | No |
| III | More than 5 cm | Yes, on same side of breast | No |
| IV | Not applicable | Not applicable | Yes |

Stage 0 cancer is a contained cancer that has not spread beyond the breast ductal system. Fifteen to twenty percent of breast cancers detected by clinical examinations or testing are in Stage 0 (the earliest form of breast cancer). Two types of Stage 0 cancer are lobular carcinoma in situ (LCIS) and ductal carcinoma in situ (DCIS). LCIS indicates high risk for breast cancer. Many physicians do not classify LCIS as a malignancy and often encounter LCIS by chance on breast biopsy while investigating another area of concern. While the microscopic features of LCIS are abnormal and are similar to malignancy, LCIS does not behave as a cancer (and therefore is not treated as a cancer). LCIS is merely a marker for a significantly increased risk of cancer anywhere in the breast. However, bilateral simple mastectomy may be occasionally performed if LCIS patients have a strong family history of breast cancer. In DCIS the cancer cells are confined to milk ducts in the breast and have not spread into the fatty breast tissue or to any other part of the body (such as the lymph nodes). DCIS may be detected on mammogram as tiny specks of calcium (known as microcalcifications) 80% of the time. Less commonly DCIS can present itself as a mass with calcifications (15% of the time); and even less likely as a mass without calcifications (<5% of the time). A breast biopsy is used to confirm DCIS. A standard DCIS treatment is breast-conserving therapy (BCT), which is lumpectomy followed by radiation treatment or mastectomy. To date, DCIS patients have chosen equally among lumpectomy and mastectomy as their treatment option, though specific cases may sometimes favor lumpectomy over mastectomy or vice versa.

In Stage I, the primary cancer is 2 cm or less in diameter and has not spread to the lymph nodes. In Stage IIA, the primary tumor is between 2 and 5 cm in diameter and has not spread to the lymph nodes. In Stage IIB, the primary tumor is between 2 and 5 cm in diameter and has spread to the axillary (underarm) lymph nodes; or the primary tumor is over 5 cm and has not spread to the lymph nodes. In Stage IIIA, the primary breast cancer of any kind that has spread to the axillary (underarm) lymph nodes and to axillary tissues. In Stage IIIB, the primary breast cancer is any size, has attached itself to the chest wall, and has spread to the pectoral (chest) lymph nodes. In Stage IV, the primary cancer has spread out of the breast to other parts of the body (such as bone, lung, liver, brain). The treatment of Stage IV breast cancer focuses on extending survival time and relieving symptoms.

Based in part upon selection criteria set forth above, individuals having breast cancer can be selected for genetic studies. Also, individuals having no history of cancer or breast cancer often are selected for genetic studies. Other selection criteria can include: a tissue or fluid sample is derived from an individual characterized as Caucasian; the sample was derived from an individual of German paternal and maternal descent; the database included relevant phenotype information for the individual; case samples were derived from individuals diagnosed with breast cancer; control samples were derived from individuals free of cancer and no family history of breast cancer; and sufficient genomic DNA was extracted from each blood sample for all allelotyping and genotyping reactions performed during the study. Phenotype information included pre- or post-menopausal, familial predisposition, country or origin of mother and father, diagnosis with breast cancer (date of primary diagnosis, age of individual as of primary diagnosis, grade or stage of development, occurrence of metastases, e.g., lymph node metastases, organ metastases), condition of body tissue (skin tissue, breast tissue, ovary tissue, peritoneum tissue and myometrium), method of treatment (surgery, chemotherapy, hormone therapy, radiation therapy).

Provided herein is a set of blood samples and a set of corresponding nucleic acid samples isolated from the blood samples, where the blood samples are donated from individuals diagnosed with breast cancer. The sample set often includes blood samples or nucleic acid samples from 100 or more, 150 or more, or 200 or more individuals having breast cancer, and sometimes from 250 or more, 300 or more, 400 or more, or 500 or more individuals. The individuals can have parents from any place of origin, and in an embodiment, the set of samples are extracted from individuals of German paternal and German maternal ancestry. The samples in each set may be selected based upon five or more criteria and/or phenotypes set forth above.

Polymorphic Variants Associated with Breast Cancer

A genetic analysis provided herein linked breast cancer with polymorphic variants in the ICAM, MAPK10, KIAA0861, NUMA1 and GALE regions of the human genome disclosed herein. As used herein, the term "polymorphic site" refers to a region in a nucleic acid at which two or more alternative nucleotide sequences are observed in a significant number of nucleic acid samples from a population of individuals. A polymorphic site may be a nucleotide sequence of two or more nucleotides, an inserted nucleotide or nucleotide sequence, a deleted nucleotide or nucleotide sequence, or a microsatellite, for example. A polymorphic site that is two or more nucleotides in length may be 3, 4, 5, 6, 7, 8, 9, 10, 11, 12, 13, 14, 15 or more, 20 or more, 30 or more, 50 or more, 75 or more, 100 or more, 500 or more, or about 1000 nucleotides in length, where all or some of the nucleotide sequences differ within the region. A polymorphic site is often one nucleotide in length, which is referred to herein as a "single nucleotide polymorphism" or a "SNP."

Where there are two, three, or four alternative nucleotide sequences at a polymorphic site, each nucleotide sequence is referred to as a "polymorphic variant" or "nucleic acid variant." Where two polymorphic variants exist, for example, the polymorphic variant represented in a minority of samples from a population is sometimes referred to as a "minor allele" and the polymorphic variant that is more prevalently represented is sometimes referred to as a "major allele." Many organisms possess a copy of each chromosome (e.g., humans), and those individuals who possess two major alleles or two minor alleles are often referred to as being "homozygous" with respect to the polymorphism, and those individuals who possess one major allele and one minor allele are normally referred to as being "heterozygous" with respect to the polymorphism. Individuals who are homozygous with respect to one allele are sometimes predisposed to a different phenotype as compared to individuals who are heterozygous or homozygous with respect to another allele.

Furthermore, a genotype or polymorphic variant may be expressed in terms of a "haplotype," which as used herein refers to two or more polymorphic variants occurring within genomic DNA in a group of individuals within a population. For example, two SNPs may exist within a gene where each SNP position includes a cytosine variation and an adenine variation. Certain individuals in a population may carry one allele (heterozygous) or two alleles (homozygous) having the gene with a cytosine at each SNP position. As the two cytosines corresponding to each SNP in the gene travel together on one or both alleles in these individuals, the individuals can be characterized as having a cytosine/cytosine haplotype with respect to the two SNPs in the gene.

As used herein, the term "phenotype" refers to a trait which can be compared between individuals, such as presence or absence of a condition, a visually observable difference in appearance between individuals, metabolic variations, physiological variations, variations in the function of biological molecules, and the like. An example of a phenotype is occurrence of breast cancer.

Researchers sometimes report a polymorphic variant in a database without determining whether the variant is represented in a significant fraction of a population. Because a subset of these reported polymorphic variants are not represented in a statistically significant portion of the population, some of them are sequencing errors and/or not biologically relevant. Thus, it is often not known whether a reported polymorphic variant is statistically significant or biologically relevant until the presence of the variant is detected in a population of individuals and the frequency of the variant is determined. Methods for detecting a polymorphic variant in a population are described herein, specifically in Example 2. A polymorphic variant is statistically significant and often biologically relevant if it is represented in 5% or more of a population, sometimes 10% or more, 15% or more, or 20% or more of a population, and often 25% or more, 30% or more, 35% or more, 40% or more, 45% or more, or 50% or more of a population.

A polymorphic variant may be detected on either or both strands of a double-stranded nucleic acid. For example, a thymine at a particular position in SEQ ID NO: 1 can be reported as an adenine from the complementary strand. Also, a polymorphic variant may be located within an intron or exon of a gene or within a portion of a regulatory region such as a promoter, a 5' untranslated region (UTR), a 3' UTR, and in DNA (e.g., genomic DNA (gDNA) and complementary DNA (cDNA)), RNA (e.g., mRNA, tRNA, and rRNA), or a polypeptide. Polymorphic variations may or may not result in detectable differences in gene expression, polypeptide structure, or polypeptide function.

In the genetic analysis that associated breast cancer with the polymorphic variants described hereafter, samples from individuals having breast cancer and individuals not having cancer were allelotyped and genotyped. The term "genotyped" as used herein refers to a process for determining a genotype of one or more individuals, where a "genotype" is a representation of one or more polymorphic variants in a population. Genotypes may be expressed in terms of a "haplotype," which as used herein refers to two or more polymorphic variants occurring within genomic DNA in a group of individuals within a population. For example, two SNPs may exist within a gene where each SNP position includes a cytosine variation and an adenine variation. Certain individuals in a population may carry one allele (heterozygous) or two alleles (homozygous) having the gene with a cytosine at each SNP position. As the two cytosines corresponding to each SNP in the gene travel together on one or both alleles in these individuals, the individuals can be characterized as having a cytosine/cytosine haplotype with respect to the two SNPs in the gene.

It was determined that polymorphic variations associated with an increased risk of breast cancer existed in ICAM, MAPK10, KIAA0861, NUMA1 or GALE nucleotide sequences. Polymorphic variants in and around the ICAM, MAPK10, KIAA0861, NUMA1 and GALE loci were tested for association with breast cancer. In the ICAM locus, these included polymorphic variants at positions in SEQ ID NO: 1 selected from the group consisting of 139, 11799, 11851, 11851, 11963, 24282, 26849, 29633, 31254, 31967, 32920, 33929, 35599, 36101, 36101, 36340, 36405, 36517, 36777, 36992, 37645, 37868, 38440, 38440, 38532, 38532, 38547, 38547, 38712, 40684, 40860, 41213, 41419, 41613, 42407, 43440, 43440, 44247, 44247, 44247, 44247, 44677, 44677, 45256, 45256, 45536, 45536, 46153, 47546, 47697, 47944, 47944, 48530, 51102, 57090, 60093, 60439, 62694, 66260, 67295, 67295, 67304, 67731, 67731, 68555, 68555, 70429, 70875, 72360, 74228, 76802, 77664, 78803, 79263, 80810, 81020, 82426, 82783, 85912, 85912, 86135, 86135, 87877, 87877, 88043, 88043, 88206, 88343, 90701, 90701, 90974, 91060, 91087, 91594, 91594, 92302, 92384, 36517, and 44677. Polymorphic variants in a region spanning positions 11851-24282, 36340-37868, 41213-41613, 70875-74228, 42407-45536, and 42407-51102 in SEQ ID NO: 1 in particular were associated with an increased risk of breast cancer, including polymorphic variants at positions 11963, 36340, 36992, 37868, 41213, 41419, 41613, 42407, 44247, 44677, 45256, 45536, 51102, 72360, 36517, and 44677 in SEQ ID NO: 1. At these positions in SEQ ID NO: 1, an adenine at position 11963, a guanine at position 36340, an adenine at position 36992, a guanine at position 37868, a cytosine at position 41213, a guanine at position 41419, a guanine at position 41613, a cytosine at position 42407, a cytosine at position 44247, an adenine or cytosine at position 44677, a thymine at position 45256, a guanine at position 45536, a cytosine at position 51102, a guanine at position 72360, a cytosine at position 36517, and guanine at position 44677, in particular were associated with risk of breast cancer. Also, a proline at amino acid position 352 or an alanine at amino acid position 348 in SEQ ID NO: 15 were in particular associated with an increased risk of breast cancer.

In the MAPK10 locus, these included polymorphic variants at positions in SEQ ID NO: 2 selected from the group consisting of 191, 1490, 3781, 3935, 4512, 7573, 8467, 9001, 9732, 13477, 13787, 13903, 14355, 15053, 15459, 17762, 19482, 19631, 22170, 22688, 22748, 23376, 23826, 23868, 24154, 25972, 26057, 26361, 26599, 26712, 26812, 27069, 32421, 33557, 35127, 35222, 35999, 36424, 37403, 39203, 39226, 41147, 46176, 50452, 52919, 60214, 61093, 62572, 63601, 65362, 65863, 66207, 66339, 69512, 70759, 71217, 73382, and 76307. Polymorphic variants in a region spanning positions 23826-36424, 46176-62572, 4512-8467 or 13787-14355 in SEQ ID NO: 2 in particular were associated with an increased risk of breast cancer, including polymorphic variants at positions 7573, 13903, 23826, 26057, 26361, 26599, 26812, 27069, 35127, 35222, 36424, 46176, 50452, 61093, 62572, and 70759 in SEQ ID NO: 2. At these positions in SEQ ID NO: 2, a guanine at position 7573, a guanine at position 13903, an adenine at position 23826, an adenine at position 26057, a thymine at position 26361, an adenine at position 26599, an adenine at position 26812, a cytosine at position 27069, an adenine at position 35127, a thymine at position 35222, a cytosine at position 36424, a cytosine at position 46176, a cytosine at position 50452, a guanine at position 61093, an adenine at position 62572, and a guanine at position 70759, in particular were associated with risk of breast cancer.

In the KIAA0861 locus, these included polymorphic variants at positions in SEQ ID NO: 3 selected from the group consisting of 107, 2157, 7300, 8233, 9647, 9868, 9889, 10621, 11003, 11507, 11527, 11718, 11808, 12024, 13963, 14300, 14361, 16287, 18635, 19365, 24953, 25435, 26847, 27492, 27620, 27678, 27714, 29719, 30234, 31909, 32153, 33572, 42164, 43925, 45031, 45655, 48350, 48418, 48563, 53189, 56468, 59358, 63761, 65931, 67040, 69491, 83308, 126545, 137592, and 147169. Polymorphic variants in a region spanning positions 42164-48563 in SEQ ID NO: 3 in particular were associated with an increased risk of breast cancer, including polymorphic variants at positions 107, 42164, 45031, 45655, 48563, 19365 and 14361 in SEQ ID NO: 3. At these positions in SEQ ID NO: 3, an adenine at position 107, a thymine at position 14361, a guanine at position 19365, a thymine at position 42164, a cytosine at position 45031, a thymine at position 45655 and a cytosine at position 48563, in particular were associated with risk of breast cancer. Also, leucine at amino acid position 359 in SEQ ID NO: 17, a leucine at amino acid position 378 in SEQ ID NO: 17, or an alanine at amino acid position 857 in SEQ ID NO: 17 were in particular associated with an increased risk of breast cancer.

In the NUMA1 locus, these included polymorphic variants at positions in SEQ ID NO: 4 selected from the group consisting of 174, 815, 3480, 9715, 14755, 15912, 19834, 19850, 20171, 20500, 20536, 23187, 25289, 25470, 28720, 29566, 30155, 30752, 32710, 32954, 33725, 33842, 36345, 38115, 39150, 40840, 41969, 42045, 43785, 44444, 44579, 45386, 46827, 47320, 47625, 47837, 47866, 49002, 49566, 52058, 52249, 52257, 52850, 53860, 54052, 54411, 55098, 55303, 59398, 59533, 60542, 61541, 62309, 72299, 73031, 73803, 80950, 82137, 96077, 96470, 98116, 98184, and 132952. Polymorphic variants in a region spanning positions 174-32954, 38115-43785, 45386-52058, 52257-54411, 55303-73803 or 96470-98184 in SEQ ID NO: 4 in particular were associated with an increased risk of breast cancer, including polymorphic variants at positions 174, 815, 3480, 19834, 19850, 20171, 20500, 20536, 23187, 25470, 30155, 30752, 32710, 32954, 38115, 39150, 40840, 41969, 42045, 43785, 45386, 46827, 47320, 47625, 47837, 47866, 49002, 49566, 52058, 52257, 52850, 53860, 54052, 54411, 55303, 59398, 60542, 62309, 72299, 73031, 73803, and 98116 in SEQ ID NO: 4. At these positions in SEQ ID NO: 4, a thymine at position 174, an adenine at position 815, a cytosine at position 3480, a guanine at position 19834, an adenine at position 19850, a thymine at position 20171, a thymine at position 20500, a cytosine at position 20536, a cytosine at position 23187, a thymine at position 25470, a thymine at position 30155, a guanine at position 30752, a thymine at position 32710, a guanine at position 32954, an adenine at position 38115, a cytosine at position 39150, a thymine at position 40840, an adenine at position 41969, a thymine at position 42045, a guanine at position 43785, a cytosine at position 45386, an adenine at position 46827, an adenine at position 47320, a cytosine at position 47625, a cytosine at position 47837, an adenine at position 47866, a cytosine at position 49002, a thymine at position 49566, a cytosine at position 52058, a thymine at position 52257, a thymine at position 52850, a cytosine at position 53860, a cytosine at position 54052, a thymine at position 54411, a cytosine at position 55303, an adenine at position 59398, an adenine at position 60542, an adenine at position 62309, a cytosine at position 72299, a thymine at position 73031, a guanine at position 73803, and a thymine at position 98116, in particular were associated with risk of breast cancer. In the GALE locus, a polymorphic variant at position 174 in SEQ ID NO: 5 was in particular associated with increased risk of breast cancer, and an adenine this position was the cancer-associated allele.

Additional Polymorphic Variants Associated with Breast Cancer

Also provided is a method for identifying polymorphic variants proximal to an incident, founder polymorphic variant associated with breast cancer. Thus, featured herein are methods for identifying a polymorphic variation associated with breast cancer that is proximal to an incident polymorphic variation associated with breast cancer, which comprises identifying a polymorphic variant proximal to the incident polymorphic variant associated with breast cancer, where the incident polymorphic variant is in a nucleotide sequence set forth in SEQ ID NO: 1-5. The nucleotide sequence often comprises a polynucleotide sequence selected from the group consisting of (a) a nucleotide sequence set forth in SEQ ID NO: 1-5; (b) a nucleotide sequence which encodes a polypeptide having an amino acid sequence encoded by a nucleotide sequence in SEQ ID NO: 1-5; (c) a nucleotide sequence which encodes a polypeptide that is 90% or more identical to an amino acid sequence encoded by a nucleotide sequence in SEQ ID NO: 1-5 or a nucleotide sequence about 90% or more identical to the nucleotide sequence set forth in SEQ ID NO: 1-5; and (d) a fragment of a nucleotide sequence of (a), (b), or (c), often a fragment that includes a polymorphic site associated with breast cancer. The presence or absence of an association of the proximal polymorphic variant with breast cancer then is determined using a known association method, such as a method described in the Examples hereafter. In an embodiment, the incident polymorphic variant is described in SEQ ID NO: 1-5. In another embodiment, the proximal polymorphic variant identified sometimes is a publicly disclosed polymorphic variant, which for example, sometimes is published in a publicly available database. In other embodiments, the polymorphic variant identified is not publicly disclosed and is discovered using a known method, including, but not limited to, sequencing a region surrounding the incident polymorphic variant in a group of nucleic acid samples. Thus, multiple polymorphic variants proximal to an incident polymorphic variant are associated with breast cancer using this method.

The proximal polymorphic variant often is identified in a region surrounding the incident polymorphic variant. In certain embodiments, this surrounding region is about 50 kb flanking the first polymorphic variant (e.g. about 50 kb 5' of the first polymorphic variant and about 50 kb 3' of the first polymorphic variant), and the region sometimes is composed of shorter flanking sequences, such as flanking sequences of about 40 kb, about 30 kb, about 25 kb, about 20 kb, about 15 kb, about 10 kb, about 7 kb, about 5 kb, or about 2 kb 5' and 3' of the incident polymorphic variant. In other embodiments, the region is composed of longer flanking sequences, such as flanking sequences of about 55 kb, about 60 kb, about 65 kb, about 70 kb, about 75 kb, about 80 kb, about 85 kb, about 90 kb, about 95 kb, or about 100 kb 5' and 3' of the incident polymorphic variant.

In certain embodiments, polymorphic variants associated with breast cancer are identified iteratively. For example, a first proximal polymorphic variant is associated with breast cancer using the methods described above and then another polymorphic variant proximal to the first proximal polymorphic variant is identified (e.g., publicly disclosed or discovered) and the presence or absence of an association of one or more other polymorphic variants proximal to the first proximal polymorphic variant with breast cancer is determined.

The methods described herein are useful for identifying or discovering additional polymorphic variants that may be used to further characterize a gene, region or loci associated with a condition, a disease (e.g., breast cancer), or a disorder. For example, allelotyping or genotyping data from the additional polymorphic variants may be used to identify a functional mutation or a region of linkage disequilibrium.

In certain embodiments, polymorphic variants identified or discovered within a region comprising the first polymorphic variant associated with breast cancer are genotyped using the genetic methods and sample selection techniques described herein, and it can be determined whether those polymorphic variants are in linkage disequilibrium with the first polymorphic variant. The size of the region in linkage disequilibrium with the first polymorphic variant also can be assessed using these genotyping methods. Thus, provided herein are methods for determining whether a polymorphic variant is in linkage disequilibrium with a first polymorphic variant associated with breast cancer, and such information can be used in prognosis methods described herein.

Isolated ICAM, MAPK10, KIAA0861, NUMA1 or GALE Nucleic Acids

Featured herein are isolated ICAM, MAPK10, KIAA0861, NUMA1 or GALE nucleic acids, which include the nucleic acid having the nucleotide sequence of SEQ ID NO: 1, 2, 3, 4, 5, 6, 7, 8, 9, 10 or 11, nucleic acid variants, and substantially identical nucleic acids of the foregoing. Nucleotide sequences of the ICAM, MAPK10, KIAA0861, NUMA1 or GALE nucleic acids sometimes are referred to herein as "ICAM, MAPK10, KIAA0861, NUMA1 or GALE nucleotide sequences." A "ICAM, MAPK10, KIAA0861, NUMA1 or GALE nucleic acid variant" refers to one allele that may have one or more different polymorphic variations as compared to another allele in another subject or the same subject. A polymorphic variation in the ICAM, MAPK10, KIAA0861, NUMA1 or GALE nucleic acid variant may be represented on one or both strands in a double-stranded nucleic acid or on one chromosomal complement (heterozygous) or both chromosomal complements (homozygous).

As used herein, the term "nucleic acid" includes DNA molecules (e.g., a complementary DNA (cDNA) and genomic DNA (gDNA)) and RNA molecules (e.g., mRNA, rRNA, and tRNA) and analogs of DNA or RNA, for example, by use of nucleotide analogs. The nucleic acid molecule can be single-stranded and it is often double-stranded. The term "isolated or purified nucleic acid" refers to nucleic acids that are separated from other nucleic acids present in the natural source of the nucleic acid. For example, with regard to genomic DNA, the term "isolated" includes nucleic acids which are separated from the chromosome with which the genomic DNA is naturally associated. An "isolated" nucleic acid is often free of sequences which naturally flank the nucleic acid (i.e., sequences located at the 5' and/or 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb or 0.1 kb of 5' and/or 3' nucleotide sequences which flank the nucleic acid molecule in genomic DNA of the cell from which the nucleic acid is derived. Moreover, an "isolated" nucleic acid molecule, such as a cDNA molecule, can be substantially free of other cellular material, or culture medium when produced by recombinant techniques, or substantially free of chemical precursors or other chemicals when chemically synthesized. As used herein, the term "ICAM, MAPK10, KIAA0861, NUMA1 or GALE gene" refers to a nucleotide sequence that encodes a ICAM, MAPK10, KIAA0861, NUMA1 or GALE polypeptide.

Also included herein are nucleic acid fragments. These fragments typically are a nucleotide sequence identical to a nucleotide sequence in SEQ ID NO: 1-12, a nucleotide sequence substantially identical to a nucleotide sequence in SEQ ID NO: 1-12, or a nucleotide sequence that is complementary to the foregoing. The nucleic acid fragment may be identical, substantially identical or homologous to a nucleotide sequence in an exon or an intron in SEQ ID NO: 1-5, and may encode a domain or part of a domain or motif of a ICAM, MAPK10, KIAA0861, NUMA1 or GALE polypeptide. Sometimes, the fragment will comprises the polymorphic variation described herein as being associated with breast cancer. The nucleic acid fragment sometimes is 50, 100, or 200 or fewer base pairs in length, and is sometimes about 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3800, 4000, 5000, 6000, 7000, 8000, 9000, 10000, 15000, 20000, 30000, 40000, 50000, 60000, 70000, 80000, 90000, 100000, 110000, 120000, 130000, 140000, 150000 or 160000 base pairs in length. A nucleic acid fragment complementary to a nucleotide sequence identical or substantially identical to the nucleotide sequence of SEQ ID NO: 1-12 and hybridizes to such a nucleotide sequence under stringent conditions often is referred to as a "probe." Nucleic acid fragments often include one or more polymorphic sites, or sometimes have an end that is adjacent to a polymorphic site as described hereafter.

An example of a nucleic acid fragment is an oligonucleotide. As used herein, the term "oligonucleotide" refers to a nucleic acid comprising about 8 to about 50 covalently linked nucleotides, often comprising from about 8 to about 35 nucleotides, and more often from about 10 to about 25 nucleotides. The backbone and nucleotides within an oligonucleotide may be the same as those of naturally occurring nucleic acids, or analogs or derivatives of naturally occurring nucleic acids, provided that oligonucleotides having such analogs or derivatives retain the ability to hybridize specifically to a nucleic acid comprising a targeted polymorphism. Oligonucleotides described herein may be used as hybridization probes or as components of prognostic or diagnostic assays, for example, as described herein.

Oligonucleotides are typically synthesized using standard methods and equipment, such as the ABI 3900 High Throughput DNA Synthesizer and the EXPEDITE™ 8909 Nucleic Acid Synthesizer, both of which are available from Applied Biosystems (Foster City, Calif.). Analogs and derivatives are exemplified in U.S. Pat. Nos. 4,469,863; 5,536,821; 5,541,306; 5,637,683; 5,637,684; 5,700,922; 5,717,083; 5,719,262; 5,739,308; 5,773,601; 5,886,165; 5,929,226; 5,977,296; 6,140,482; WO 00/56746; WO 01/14398, and related publications. Methods for synthesizing oligonucleotides comprising such analogs or derivatives are disclosed, for example, in the patent publications cited above and in U.S. Pat. Nos. 5,614,622; 5,739,314; 5,955,599; 5,962,674; 6,117,992; in WO 00/75372; and in related publications.

Oligonucleotides also may be linked to a second moiety. The second moiety may be an additional nucleotide sequence such as a tail sequence (e.g., a polyadenosine tail), an adapter sequence (e.g., phage M13 universal tail sequence), and others. Alternatively, the second moiety may be a non-nucleotide moiety such as a moiety which facilitates linkage to a solid support or a label to facilitate detection of the oligonucleotide. Such labels include, without limitation, a radioactive label, a fluorescent label, a chemiluminescent label, a paramagnetic label, and the like. The second moiety may be attached to any position of the oligonucleotide, provided the oligonucleotide can hybridize to the nucleic acid comprising the polymorphism.

Uses for Nucleic Acid Sequences

Nucleic acid coding sequences depicted in SEQ ID NO: 1-12 may be used for diagnostic purposes for detection and control of polypeptide expression. Also, included herein are oligonucleotide sequences such as antisense RNA, small-interfering RNA (siRNA) and DNA molecules and ribozymes that function to inhibit translation of a polypeptide. Antisense techniques and RNA interference techniques are known in the art and are described herein.

Ribozymes are enzymatic RNA molecules capable of catalyzing the specific cleavage of RNA. The mechanism of ribozyme action involves sequence specific hybridization of the ribozyme molecule to complementary target RNA, followed by a endonucleolytic cleavage. Ribozymes may be engineered hammerhead motif ribozyme molecules that specifically and efficiently catalyze endonucleolytic cleavage of RNA sequences corresponding to or complementary to the nucleotide sequences set forth in SEQ ID NO: 1-12. Specific ribozyme cleavage sites within any potential RNA target are initially identified by scanning the target molecule for ribozyme cleavage sites which include the following sequences, GUA, GUU and GUC. Once identified, short RNA sequences of between fifteen (15) and twenty (20) ribonucleotides corresponding to the region of the target gene containing the cleavage site may be evaluated for predicted structural features such as secondary structure that may render the oligonucleotide sequence unsuitable. The suitability of candidate targets may also be evaluated by testing their accessibility to hybridization with complementary oligonucleotides, using ribonuclease protection assays.

Antisense RNA and DNA molecules, siRNA and ribozymes may be prepared by any method known in the art for the synthesis of RNA molecules. These include techniques for chemically synthesizing oligodeoxyribonucleotides well known in the art such as solid phase phosphoramidite chemical synthesis. Alternatively, RNA molecules may be generated by in vitro and in vivo transcription of DNA sequences encoding the antisense RNA molecule. Such DNA sequences may be incorporated into a wide variety of vectors which incorporate suitable RNA polymerase promoters such as the T7 or SP6 polymerase promoters. Alternatively, antisense cDNA constructs that synthesize antisense RNA constitutively or inducibly, depending on the promoter used, can be introduced stably into cell lines.

DNA encoding a polypeptide also may have a number of uses for the diagnosis of diseases, including breast cancer, resulting from aberrant expression of a target gene described herein. For example, the nucleic acid sequence may be used in hybridization assays of biopsies or autopsies to diagnose abnormalities of expression or function (e.g., Southern or Northern blot analysis, in situ hybridization assays).

In addition, the expression of a polypeptide during embryonic development may also be determined using nucleic acid encoding the polypeptide. As addressed, infra, production of functionally impaired polypeptide can be the cause of various disease states, such as breast cancer. In situ hybridizations using polynucleotide probes may be employed to predict problems related to breast cancer. Further, as indicated, infra, administration of human active polypeptide, recombinantly produced as described herein, may be used to treat disease states related to functionally impaired polypeptide. Alternatively, gene therapy approaches may be employed to remedy deficiencies of functional polypeptide or to replace or compete with dysfunctional polypeptide.

Expression Vectors, Host Cells, and Genetically Engineered Cells

Provided herein are nucleic acid vectors, often expression vectors, which contain a ICAM, MAPK10, KIAA0861, NUMA1 or GALE nucleic acid. As used herein, the term "vector" refers to a nucleic acid molecule capable of transporting another nucleic acid to which it has been linked and can include a plasmid, cosmid, or viral vector. The vector can be capable of autonomous replication or it can integrate into a host DNA. Viral vectors may include replication defective retroviruses, adenoviruses and adeno-associated viruses for example.

A vector can include a ICAM, MAPK10, KIAA0861, NUMA1 or GALE nucleic acid in a form suitable for expression of the nucleic acid in a host cell. The recombinant expression vector typically includes one or more regulatory sequences operatively linked to the nucleic acid sequence to be expressed. The term "regulatory sequence" includes promoters, enhancers and other expression control elements (e.g., polyadenylation signals). Regulatory sequences include those that direct constitutive expression of a nucleotide sequence, as well as tissue-specific regulatory and/or inducible sequences. The design of the expression vector can depend on such factors as the choice of the host cell to be transformed, the level of expression of polypeptide desired, and the like. Expression vectors can be introduced into host cells to produce ICAM, MAPK10, KIAA0861, NUMA1 or GALE polypeptides, including fusion polypeptides, encoded by ICAM, MAPK10, KIAA0861, NUMA1 or GALE nucleic acids.

Recombinant expression vectors can be designed for expression of ICAM, MAPK10. KIAA0861, NUMA1 or GALE polypeptides in prokaryotic or eukaryotic cells. For example, ICAM, MAPK10, KIAA0861, NUMA1 or GALE polypeptides can be expressed in E. coli, insect cells (e.g., using baculovirus expression vectors), yeast cells, or mammalian cells. Suitable host cells are discussed further in Goeddel, Gene Expression Technology: Methods in Enzymology 185, Academic Press, San Diego, Calif. (1990). Alternatively, the recombinant expression vector can be transcribed and translated in vitro, for example using T7 promoter regulatory sequences and T7 polymerase.

Expression of polypeptides in prokaryotes is most often carried out in *E. coli* with vectors containing constitutive or inducible promoters directing the expression of either fusion or non-fusion polypeptides. Fusion vectors add a number of amino acids to a polypeptide encoded therein, usually to the amino terminus of the recombinant polypeptide. Such fusion vectors typically serve three purposes: 1) to increase expression of recombinant polypeptide; 2) to increase the solubility of the recombinant polypeptide; and 3) to aid in the purification of the recombinant polypeptide by acting as a ligand in affinity purification. Often, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin and enterokinase. Typical fusion expression vectors include pGEX (Pharmacia Biotech Inc; Smith & Johnson, Gene 67: 31-40 (1988)), pMAL (New England Biolabs, Beverly, Mass.) and pRIT5 (Pharmacia, Piscataway, N.J.) which fuse glutathione S-transferase (GST), maltose E binding polypeptide, or polypeptide A, respectively, to the target recombinant polypeptide.

Purified fusion polypeptides can be used in screening assays and to generate antibodies specific for ICAM, MAPK10, KIAA0861, NUMA1 or GALE polypeptides. In a therapeutic embodiment, fusion polypeptide expressed in a retroviral expression vector is used to infect bone marrow cells that are subsequently transplanted into irradiated recipients. The pathology of the subject recipient is then examined after sufficient time has passed (e.g., six (6) weeks).

Expressing the polypeptide in host bacteria with an impaired capacity to proteolytically cleave the recombinant polypeptide is often used to maximize recombinant polypeptide expression (Gottesman, S., Gene Expression Technology: Methods in Enzymology, Academic Press, San Diego, Calif. 185: 119-128 (1990)). Another strategy is to alter the nucleotide sequence of the nucleic acid to be inserted into an expression vector so that the individual codons for each amino acid are those preferentially utilized in *E. coli* (Wada et al., Nucleic Acids Res. 20: 2111-2118 (1992)). Such alteration of nucleotide sequences can be carried out by standard DNA synthesis techniques.

When used in mammalian cells, the expression vector's control functions are often provided by viral regulatory elements. For example, commonly used promoters are derived from polyoma, Adenovirus 2, cytomegalovirus and Simian Virus 40. Recombinant mammalian expression vectors are often capable of directing expression of the nucleic acid in a particular cell type (e.g., tissue-specific regulatory elements are used to express the nucleic acid). Non-limiting examples of suitable tissue-specific promoters include an albumin promoter (liver-specific; Pinkert et al., Genes Dev. 1: 268-277 (1987)), lymphoid-specific promoters (Calame & Eaton, Adv. Immunol. 43: 235-275 (1988)), promoters of T cell receptors (Winoto & Baltimore, EMBO J. 8: 729-733 (1989)) promoters of immunoglobulins (Banerji et al., Cell 33: 729-740 (1983); Queen & Baltimore, Cell 33: 741-748 (1983)), neuron-specific promoters (e.g., the neurofilament promoter; Byrne & Ruddle, Proc. Natl. Acad. Sci. USA 86: 5473-5477 (1989)), pancreas-specific promoters (Edlund et al., Science 230: 912-916 (1985)), and mammary gland-specific promoters (e.g., milk whey promoter; U.S. Pat. No. 4,873,316 and European Application Publication No. 264,166). Developmentally-regulated promoters are sometimes utilized, for example, the murine hox promoters (Kessel & Gruss, Science 249: 374-379 (1990)) and the α-fetopolypeptide promoter (Campes & Tilghman, Genes Dev. 3: 537-546 (1989)).

A ICAM, MAPK10, KIAA0861, NUMA1 or GALE nucleic acid may also be cloned into an expression vector in an antisense orientation. Regulatory sequences (e.g., viral promoters and/or enhancers) operatively linked to a ICAM, MAPK10, KIAA0861, NUMA1 or GALE nucleic acid cloned in the antisense orientation can be chosen for directing constitutive, tissue specific or cell type specific expression of antisense RNA in a variety of cell types. Antisense expression vectors can be in the form of a recombinant plasmid, phagemid or attenuated virus. For a discussion of the regulation of gene expression using antisense genes see Weintraub et al., Antisense RNA as a molecular tool for genetic analysis, Reviews—Trends in Genetics, Vol. 1(1) (1986).

Also provided herein are host cells that include a ICAM, MAPK10, KIAA0861, NUMA1 or GALE nucleic acid within a recombinant expression vector or ICAM, MAPK10, KIAA0861, NUMA1 or GALE nucleic acid sequence fragments which allow it to homologously recombine into a specific site of the host cell genome. The terms "host cell" and "recombinant host cell" are used interchangeably herein. Such terms refer not only to the particular subject cell but rather also to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, a ICAM, MAPK10, KIAA0861, NUMA1 or GALE polypeptide can be expressed in bacterial cells such as *E. coli*, insect cells, yeast or mammalian cells (such as Chinese hamster ovary cells (CHO) or COS cells). Other suitable host cells are known to those skilled in the art.

Vectors can be introduced into host cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, transduction/infection, DEAE-dextran-mediated transfection, lipofection, or electroporation.

A host cell provided herein can be used to produce (i.e., express) a ICAM, MAPK10, KIAA0861, NUMA1 or GALE polypeptide. Accordingly, further provided are methods for producing a ICAM, MAPK10, KIAA0861, NUMA1 or GALE polypeptide using the host cells described herein. In one embodiment, the method includes culturing host cells into which a recombinant expression vector encoding a ICAM, MAPK10, KIAA0861, NUMA1 or GALE polypeptide has been introduced in a suitable medium such that a ICAM, MAPK10, KIAA0861, NUMA1 or GALE polypeptide is produced. In another embodiment, the method further includes isolating a ICAM, MAPK10, KIAA0861, NUMA1 or GALE polypeptide from the medium or the host cell.

Also provided are cells or purified preparations of cells which include a ICAM, MAPK10, KIAA0861, NUMA1 or GALE transgene, or which otherwise misexpress ICAM, MAPK10, KIAA0861, NUMA1 or GALE polypeptide. Cell preparations can consist of human or non-human cells, e.g., rodent cells, e.g., mouse or rat cells, rabbit cells, or pig cells. In certain embodiments, the cell or cells include a ICAM, MAPK10, KIAA0861, NUMA1 or GALE transgene (e.g., a heterologous form of a ICAM, MAPK10, KIAA0861, NUMA1 or GALE such as a human gene expressed in non-human cells). The ICAM, MAPK10, KIAA0861, NUMA1 or GALE transgene can be misexpressed, e.g., overexpressed or underexpressed. In other embodiments, the cell or cells include a gene which misexpress an endogenous ICAM, MAPK10, KIAA0861, NUMA1 or GALE polypeptide (e.g., expression of a gene is disrupted, also known as a knockout). Such cells can serve as a model for studying disorders which are related to mutated or mis-expressed ICAM, MAPK10, KIAA0861, NUMA1 or GALE alleles or for use in drug screening. Also provided are human cells (e.g., a hematopoietic stem cells) transformed with a ICAM, MAPK10, KIAA0861, NUMA1 or GALE nucleic acid.

Also provided are cells or a purified preparation thereof (e.g., human cells) in which an endogenous ICAM, MAPK10, KIAA0861, NUMA1 or GALE nucleic acid is under the control of a regulatory sequence that does not normally control the expression of the endogenous ICAM, MAPK10, KIAA0861, NUMA1 or GALE gene. The expression characteristics of an endogenous gene within a cell (e.g., a cell line or microorganism) can be modified by inserting a heterologous DNA regulatory element into the genome of the cell such that the inserted regulatory element is operably linked to the endogenous ICAM, MAPK10, KIAA0861, NUMA1 or GALE gene. For example, an endogenous ICAM, MAPK10, KIAA0861, NUMA1 or GALE gene (e.g., a gene which is "transcriptionally silent," not normally expressed, or expressed only at very low levels) may be activated by inserting a regulatory element which is capable of promoting the expression of a normally expressed gene product in that cell. Techniques such as targeted homologous recombinations, can be used to insert the heterologous DNA as described in, e.g., Chappel, U.S. Pat. No. 5,272,071; WO 91/06667, published on May 16, 1991.

Transgenic Animals

Non-human transgenic animals that express a heterologous ICAM, MAPK10, KIAA0861, NUMA1 or GALE polypeptide (e.g., expressed from a ICAM, MAPK10, KIAA0861, NUMA1 or GALE nucleic acid isolated from another organism) can be generated. Such animals are useful for studying the function and/or activity of a ICAM, MAPK10, KIAA0861, NUMA1 or GALE polypeptide and for identifying and/or evaluating modulators of ICAM, MAPK10, KIAA0861, NUMA1 or GALE nucleic acid and ICAM, MAPK10, KIAA0861, NUMA1 or GALE polypeptide activity. As used herein, a "transgenic animal" is a non-human animal such as a mammal (e.g., a non-human primate such as chimpanzee, baboon, or macaque; an ungulate such as an equine, bovine, or caprine; or a rodent such as a rat, a mouse, or an Israeli sand rat), a bird (e.g., a chicken or a turkey), an amphibian (e.g., a frog, salamander, or newt), or an insect (e.g., *Drosophila melanogaster*), in which one or more of the cells of the animal includes a ICAM, MAPK10, KIAA0861, NUMA1 or GALE transgene. A transgene is exogenous DNA or a rearrangement (e.g., a deletion of endogenous chromosomal DNA) that is often integrated into or occurs in the genome of cells in a transgenic animal. A transgene can direct expression of an encoded gene product in one or more cell types or tissues of the transgenic animal, and other transgenes can reduce expression (e.g., a knockout). Thus, a transgenic animal can be one in which an endogenous ICAM, MAPK10, KIAA0861, NUMA1 or GALE gene has been altered by homologous recombination between the endogenous gene and an exogenous DNA molecule introduced into a cell of the animal (e.g., an embryonic cell of the animal) prior to development of the animal.

Intronic sequences and polyadenylation signals can also be included in the transgene to increase expression efficiency of the transgene. One or more tissue-specific regulatory sequences can be operably linked to a ICAM, MAPK10, KIAA0861, NUMA1 or GALE transgene to direct expression of a ICAM, MAPK10, KIAA0861, NUMA1 or GALE polypeptide to particular cells. A transgenic founder animal can be identified based upon the presence of a ICAM, MAPK10, KIAA0861, NUMA1 or GALE transgene in its genome and/or expression of ICAM, MAPK10, KIAA0861, NUMA1 or GALE mRNA in tissues or cells of the animals. A transgenic founder animal can then be used to breed additional animals carrying the transgene. Moreover, transgenic animals carrying a transgene encoding a ICAM, MAPK10, KIAA0861, NUMA1 or GALE polypeptide can further be bred to other transgenic animals carrying other transgenes.

ICAM, MAPK10, KIAA0861, NUMA1 or GALE polypeptides can be expressed in transgenic animals or plants by introducing, for example, a nucleic acid encoding the polypeptide into the genome of an animal. In certain embodiments the nucleic acid is placed under the control of a tissue specific promoter, e.g., a milk or egg specific promoter, and recovered from the milk or eggs produced by the animal. Also included is a population of cells from a transgenic animal.

ICAM, MAPK10, KIAA0861, NUMA1 and GALE Polypeptides

Featured herein are isolated ICAM, MAPK10, KIAA0861, NUMA1 or GALE polypeptides, which include polypeptides having amino acid sequences set forth in SEQ ID NO: 13-18, and substantially identical polypeptides thereof. Such polypeptides sometimes are proteins or peptides. A ICAM, MAPK10, KIAA0861, NUMA1 or GALE polypeptide is a polypeptide encoded by a ICAM, MAPK10, KIAA0861, NUMA1 or GALE nucleic acid, where one nucleic acid can encode one or more different polypeptides. An "isolated" or "purified" polypeptide or protein is substantially free of cellular material or other contaminating proteins from the cell or tissue source from which the protein is derived, or substantially free from chemical precursors or other chemicals when chemically synthesized. In one embodiment, the language "substantially free" means preparation of a ICAM, MAPK10, KIAA0861, NUMA1 or GALE polypeptide or ICAM, MAPK10, KIAA0861, NUMA1 or GALE polypeptide variant having less than about 30%, 20%, 10% and sometimes 5% (by dry weight), of non-ICAM, MAPK10, KIAA0861, NUMA1 or GALE polypeptide (also referred to herein as a "contaminating protein"), or of chemical precursors or non-ICAM, MAPK10, KIAA0861, NUMA1 or GALE chemicals. When the ICAM, MAPK10, KIAA0861, NUMA1 or GALE polypeptide or a biologically active portion thereof is recombinantly produced, it is also often substantially free of culture medium, specifically, where culture medium represents less than about 20%, sometimes less than about 10%, and often less than about 5% of the volume of the polypeptide preparation. Isolated or purified ICAM, MAPK10, KIAA0861, NUMA1 or GALE polypeptide preparations are sometimes 0.01 milligrams or more or 0.1 milligrams or more, and often 1.0 milligrams or more and 10 milligrams or more in dry weight. In specific embodiments, a polypeptide comprises a leucine at amino acid position 359 in SEQ ID NO: 17, a leucine at amino acid position 378 in SEQ ID NO: 17, or an alanine at amino acid position 857 in SEQ ID NO: 17, or a ICAM5 polypeptide comprises a proline at amino acid position 352 or an alanine at amino acid position 348 in SEQ ID NO: 15.

In another aspect, featured herein are ICAM, MAPK10, KIAA0861, NUMA1 or GALE polypeptides and biologically active or antigenic fragments thereof that are useful as reagents or targets in assays applicable to prevention, treatment or diagnosis of breast cancer. In another embodiment, provided herein are ICAM, MAPK10, KIAA0861, NUMA1 or GALE polypeptides having a ICAM, MAPK10, KIAA0861, NUMA1 or GALE activity or activities.

Further included herein are ICAM, MAPK10, KIAA0861, NUMA1 or GALE polypeptide fragments. The polypeptide fragment may be a domain or part of a domain of a ICAM, MAPK10, KIAA0861, NUMA1 or GALE polypeptide. The polypeptide fragment is often 50 or fewer, 100 or fewer, or 200 or fewer amino acids in length, and is sometimes 300, 400, 500, 600, 700, or 900 or fewer amino acids in length. In certain embodiments, the polypeptide fragment comprises, consists essentially of, or consists of, at least 6 consecutive amino acids and not more than 1211 consecutive amino acids of SEQ ID NO: 13-18, or the polypeptide fragment comprises, consists essentially of, or consists of, at least 6 consecutive amino acids and not more than 543 consecutive amino acids of SEQ ID NO: 13-18.

ICAM, MAPK10, KIAA0861, NUMA1 or GALE polypeptides described herein can be used as immunogens to produce anti-ICAM, MAPK10, KIAA0861, NUMA1 or GALE antibodies in a subject, to purify ICAM, MAPK10, KIAA0861, NUMA1 or GALE ligands or binding partners, and in screening assays to identify molecules which inhibit or enhance the interaction of ICAM, MAPK10, KIAA0861, NUMA1 or GALE with a ICAM, MAPK10, KIAA0861, NUMA1 or GALE substrate. Full-length ICAM, MAPK10, KIAA0861, NUMA1 or GALE polypeptides and polynucleotides encoding the same may be specifically substituted for a ICAM, MAPK10, KIAA0861, NUMA1 or GALE polypeptide fragment or polynucleotide encoding the same in any embodiment described herein.

Substantially identical polypeptides may depart from the amino acid sequences set forth in SEQ ID NO: 13-18 in different manners. For example, conservative amino acid modifications may be introduced at one or more positions in the amino acid sequences of SEQ ID NO: 13-18. A "conservative amino acid substitution" is one in which the amino acid is replaced by another amino acid having a similar structure and/or chemical function. Families of amino acid residues having similar structures and functions are well known. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Also, essential and non-essential amino acids may be replaced. A "non-essential" amino acid is one that can be altered without abolishing or substantially altering the biological function of a ICAM, MAPK10, KIAA0861, NUMA1 or GALE polypeptide, whereas altering an "essential" amino acid abolishes or substantially alters the biological function of a ICAM, MAPK10, KIAA0861, NUMA1 or GALE polypeptide. Amino acids that are conserved among ICAM, MAPK10, KIAA0861, NUMA1 or GALE polypeptides are typically essential amino acids.

Also, ICAM, MAPK10, KIAA0861, NUMA1 or GALE polypeptides and polypeptide variants may exist as chimeric or fusion polypeptides. As used herein, a ICAM, MAPK10, KIAA0861, NUMA1 or GALE "chimeric polypeptide" or "fusion polypeptide" includes a ICAM, MAPK10, KIAA0861, NUMA1 or GALE polypeptide linked to a non-ICAM, MAPK10, KIAA0861, NUMA1 or GALE polypeptide. A "non-ICAM, MAPK10, KIAA0861, NUMA1 or GALE polypeptide" refers to a polypeptide having an amino acid sequence corresponding to a polypeptide which is not substantially identical to the ICAM, MAPK10, KIAA0861, NUMA1 or GALE polypeptide, which includes, for example, a polypeptide that is different from the ICAM, MAPK10, KIAA0861, NUMA1 or GALE polypeptide and derived from the same or a different organism. The ICAM, MAPK10, KIAA0861, NUMA1 or GALE polypeptide in the fusion polypeptide can correspond to an entire or nearly entire ICAM, MAPK10, KIAA0861, NUMA1 or GALE polypeptide or a fragment thereof. The non-ICAM, MAPK10, KIAA0861, NUMA1 or GALE polypeptide can be fused to the N-terminus or C-terminus of the ICAM, MAPK10, KIAA0861, NUMA1 or GALE polypeptide.

Fusion polypeptides can include a moiety having high affinity for a ligand. For example, the fusion polypeptide can be a GST-ICAM, MAPK10, KIAA0861, NUMA1 or GALE fusion polypeptide in which the ICAM, MAPK10, KIAA0861, NUMA1 or GALE sequences are fused to the C-terminus of the GST sequences, or a polyhistidine-ICAM, MAPK10, KIAA0861, NUMA1 or GALE fusion polypeptide in which the ICAM, MAPK10, KIAA0861, NUMA1 or GALE polypeptide is fused at the N- or C-terminus to a string of histidine residues. Such fusion polypeptides can facilitate purification of recombinant ICAM, MAPK10 KIAA0861, NUMA1 or GALE. Expression vectors are commercially available that already encode a fusion moiety (e.g., a GST polypeptide), and a ICAM, MAPK10, KIAA0861, NUMA1 or GALE nucleic acid can be cloned into an expression vector such that the fusion moiety is linked in-frame to the ICAM, MAPK10, KIAA0861, NUMA1 or GALE polypeptide. Further, the fusion polypeptide can be a ICAM, MAPK10, KIAA0861, NUMA1 or GALE polypeptide containing a heterologous signal sequence at its N-terminus. In certain host cells (e.g., mammalian host cells), expression, secretion, cellular internalization, and cellular localization of a ICAM, MAPK10, KIAA0861, NUMA1 or GALE polypeptide can be increased through use of a heterologous signal sequence. Fusion polypeptides can also include all or a part of a serum polypeptide (e.g., an IgG constant region or human serum albumin).

ICAM, MAPK10, KIAA0861, NUMA1 or GALE polypeptides or fragments thereof can be incorporated into pharmaceutical compositions and administered to a subject in vivo. Administration of these ICAM, MAPK10, KIAA0861, NUMA1 or GALE polypeptides can be used to affect the bioavailability of a ICAM, MAPK10, KIAA0861, NUMA1 or GALE substrate and may effectively increase or decrease ICAM, MAPK10, KIAA0861, NUMA1 or GALE biological activity in a cell or effectively supplement dysfunctional or hyperactive ICAM, MAPK10, KIAA0861, NUMA1 or GALE polypeptide. ICAM, MAPK10, KIAA0861, NUMA1 or GALE fusion polypeptides may be useful therapeutically for the treatment of disorders caused by, for example, (i) aberrant modification or mutation of a gene encoding a ICAM, MAPK10, KIAA0861, NUMA1 or GALE polypeptide; (ii) mis-regulation of the ICAM, MAPK10, KIAA0861, NUMA1 or GALE gene; and (iii) aberrant post-translational modification of a ICAM, MAPK10, KIAA0861, NUMA1 or GALE polypeptide. Also, ICAM, MAPK10, KIAA0861, NUMA1 or GALE polypeptides can be used as immunogens to produce anti-ICAM, MAPK10, KIAA0861, NUMA1 or GALE antibodies in a subject, to purify ICAM, MAPK10, KIAA0861, NUMA1 or GALE ligands or binding partners, and in screening assays to identify molecules which inhibit or enhance the interaction of ICAM, MAPK10, KIAA0861, NUMA1 or GALE with a ICAM, MAPK10, KIAA0861, NUMA1 or GALE substrate.

In addition, polypeptides can be chemically synthesized using techniques known in the art (See, e.g., Creighton, 1983 Proteins. New York, N.Y.: W. H. Freeman and Company; and Hunkapiller et al., (1984) Nature July 12-18; 310(5973):105-11). For example, a relative short polypeptide fragment can be synthesized by use of a peptide synthesizer. Furthermore, if desired, non-classical amino acids or chemical amino acid analogs can be introduced as a substitution or addition into the fragment sequence. Non-classical amino acids include, but are not limited to, to the D-isomers of the common amino acids, 2,4-diaminobutyric acid, a-amino isobutyric acid, 4-aminobutyric acid, Abu, 2-amino butyric acid, g-Abu, e-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, b-alanine, fluoroamino acids, designer amino acids such as b-methyl amino acids, Ca-methyl amino acids, Na-methyl amino acids, and amino acid analogs in general. Furthermore, the amino acid can be D (dextrorotary) or L (levorotary).

Also included are polypeptide fragments which are differentially modified during or after translation, e.g., by glycosylation, acetylation, phosphorylation, amidation, derivatization by known protecting/blocking groups, proteolytic cleavage, linkage to an antibody molecule or other cellular ligand, and the like. Any of numerous chemical modifications may be carried out by known techniques, including but not limited, to specific chemical cleavage by cyanogen bromide, trypsin, chymotrypsin, papain, V8 protease, $NaBH_4$; acetylation, formylation, oxidation, reduction; metabolic synthesis in the presence of tunicamycin; and the like.

Additional post-translational modifications include, for example, N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of prokaryotic host cell expression. The polypeptide fragments may also be modified with a detectable label, such as an enzymatic, fluorescent, isotopic or affinity label to allow for detection and isolation of the polypeptide.

Also provided are chemically modified polypeptide derivatives that may provide additional advantages such as increased solubility, stability and circulating time of the polypeptide, or decreased immunogenicity. See U.S. Pat. No. 4,179,337. The chemical moieties for derivitization may be selected from water soluble polymers such as polyethylene glycol, ethylene glycol/propylene glycol copolymers, carboxymethylcellulose, dextran, polyvinyl alcohol and the like. The polypeptides may be modified at random positions within the molecule, or at predetermined positions within the molecule and may include one, two, three or more attached chemical moieties.

The polymer may be of any molecular weight, and may be branched or unbranched. For polyethylene glycol, the molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog).

The polyethylene glycol molecules (or other chemical moieties) should be attached to the polypeptide with consideration of effects on functional or antigenic domains of the polypeptide. There are a number of attachment methods available to those skilled in the art, e.g., EP 0 401 384, herein incorporated by reference (coupling PEG to G-CSF), see also Malik et al. (1992) Exp Hematol. September; 20(8):1028-35, reporting pegylation of GM-CSF using tresyl chloride). For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues, glutamic acid residues and the C-terminal amino acid residue. Sulfhydryl groups may also be used as a reactive group for attaching the polyethylene glycol molecules. A polymer sometimes is attached at an amino group, such as attachment at the N-terminus or lysine group.

One may specifically desire proteins chemically modified at the N-terminus. Using polyethylene glycol as an illustration of the present composition, one may select from a variety of polyethylene glycol molecules (by molecular weight, branching, and the like), the proportion of polyethylene glycol molecules to protein (polypeptide) molecules in the reaction mix, the type of pegylation reaction to be performed, and the method of obtaining the selected N-terminally pegylated protein. The method of obtaining the N-terminally pegylated preparation (i.e., separating this moiety from other monopegylated moieties if necessary) may be by purification of the N-terminally pegylated material from a population of pegylated protein molecules. Selective proteins chemically modified at the N-terminus may be accomplished by reductive alkylation, which exploits differential reactivity of different types of primary amino groups (lysine versus the N-terminal) available for derivatization in a particular protein. Under the appropriate reaction conditions, substantially selective derivatization of the protein at the N-terminus with a carbonyl group containing polymer is achieved.

Substantially Identical Nucleic Acids and Polypeptides

Nucleotide sequences and polypeptide sequences that are substantially identical to a ICAM, MAPK10, KIAA0861, NUMA1 or GALE nucleotide sequence and the ICAM, MAPK10, KIAA0861, NUMA1 or GALE polypeptide sequences encoded by those nucleotide sequences are included herein. The term "substantially identical" as used herein refers to two or more nucleic acids or polypeptides sharing one or more identical nucleotide sequences or polypeptide sequences, respectively. Included are nucleotide sequences or polypeptide sequences that are 55% or more, 60% or more, 65% or more, 70% or more, 75% or more, 80% or more, 85% or more, 90% or more, 95% or more (each often within a 1%, 2%, 3% or 4% variability) or more identical to the nucleotide sequences in SEQ ID NO: 1-12 or the encoded ICAM, MAPK10, KIAA0861, NUMA1 or GALE polypeptide amino acid sequences. One test for determining whether two nucleic acids are substantially identical is to determine the percent of identical nucleotide sequences or polypeptide sequences shared between the nucleic acids or polypeptides.

Calculations of sequence identity are often performed as follows. Sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is sometimes 30% or more, 40% or more, 50% or more, often 60% or more, and more often 70% or more, 80% or more, 90% or more, 90% or more, or 100% of the length of the reference sequence. The nucleotides or amino acids at corresponding nucleotide or polypeptide positions, respectively, are then compared among the two sequences. When a position in the first sequence is occupied by the same nucleotide or amino acid as the corresponding position in the second sequence, the nucleotides or amino acids are deemed to be identical at that position. The percent identity between the two sequences is a function of the number of identical positions shared by the sequences, taking into account the number of gaps, and the length of each gap, introduced for optimal alignment of the two sequences.

Comparison of sequences and determination of percent identity between two sequences can be accomplished using a mathematical algorithm. Percent identity between two amino acid or nucleotide sequences can be determined using the algorithm of Meyers & Miller, CABIOS 4: 11-17 (1989), which has been incorporated into the ALIGN program (version 2.0), using a PAM120 weight residue table, a gap length penalty of 12 and a gap penalty of 4. Also, percent identity between two amino acid sequences can be determined using the Needleman & Wunsch, *J. Mol. Biol.* 48: 444-453 (1970) algorithm which has been incorporated into the GAP program in the GCG software package (available at the world wide web address gcg.com), using either a Blossum 62 matrix or a PAM250 matrix, and a gap weight of 16, 14, 12, 10, 8, 6, or 4 and a length weight of 1, 2, 3, 4, 5, or 6. Percent identity between two nucleotide sequences can be determined using the GAP program in the GCG software package (available at world wide web address gcg.com), using a NWSgapdna.CMP matrix and a gap weight of 40, 50, 60, 70, or 80 and a length weight of 1, 2, 3, 4, 5, or 6. A set of parameters often used is a Blossum 62 scoring matrix with a gap open penalty of 12, a gap extend penalty of 4, and a frameshift gap penalty of 5.

Another manner for determining if two nucleic acids are substantially identical is to assess whether a polynucleotide homologous to one nucleic acid will hybridize to the other nucleic acid under stringent conditions. As use herein, the term "stringent conditions" refers to conditions for hybridization and washing. Stringent conditions are known to those skilled in the art and can be found in *Current Protocols in Molecular Biology*, John Wiley & Sons, N.Y., 6.3.1-6.3.6 (1989). Aqueous and non-aqueous methods are described in that reference and either can be used. An example of stringent hybridization conditions is hybridization in 6× sodium chloride/sodium citrate (SSC) at about 45° C., followed by one or more washes in 0.2×SSC, 0.1% SDS at 50° C. Another example of stringent hybridization conditions are hybridization in 6× sodium chloride/sodium citrate (SSC) at about 45° C., followed by one or more washes in 0.2×SSC, 0.1% SDS at 55° C. A further example of stringent hybridization conditions is hybridization in 6× sodium chloride/sodium citrate (SSC) at about 45° C., followed by one or more washes in 0.2×SSC, 0.1% SDS at 60° C. Often, stringent hybridization conditions are hybridization in 6× sodium chloride/sodium citrate (SSC) at about 45° C., followed by one or more washes in 0.2×SSC, 0.1% SDS at 65° C. More often, stringency conditions are 0.5M sodium phosphate, 7% SDS at 65° C., followed by one or more washes at 0.2×SSC, 1% SDS at 65° C.

An example of a substantially identical nucleotide sequence to a ICAM, MAPK10, KIAA0861, NUMA1 or GALE nucleotide sequence is one that has a different nucleotide sequence but still encodes the same polypeptide sequence encoded by the ICAM, MAPK10, KIAA0861, NUMA1 or GALE nucleotide sequence. Another example is a nucleotide sequence that encodes a polypeptide having a polypeptide sequence that is more than 70% or more identical to, sometimes 75% or more, 80% or more, or 85% or more identical to, and often 90% or more and 95% or more identical to a polypeptide sequence encoded by a ICAM, MAPK10, KIAA0861, NUMA1 or GALE nucleotide sequence.

ICAM, MAPK10, KIAA0861, NUMA1 or GALE nucleotide sequences and ICAM, MAPK10, KIAA0861, NUMA1 or GALE amino acid sequences can be used as "query sequences" to perform a search against public databases to identify other family members or related sequences, for example. Such searches can be performed using the NBLAST and XBLAST programs (version 2.0) of Altschul et al., *J. Mol. Biol.* 215: 403-10 (1990). BLAST nucleotide searches can be performed with the NBLAST program, score=100, wordlength=12 to obtain nucleotide sequences homologous to nucleotide sequences from SEQ ID NO: 1-12. BLAST polypeptide searches can be performed with the XBLAST program, score=50, wordlength=3 to obtain amino acid sequences homologous to polypeptides encoded by a ICAM, MAPK10,KIAA0861, NUMA1 or GALE nucleotide sequence. To obtain gapped alignments for comparison purposes, Gapped BLAST can be utilized as described in Altschul et al, *Nucleic Acids Res.* 25(17): 3389-3402 (1997). When utilizing BLAST and Gapped BLAST programs, default parameters of the respective programs (e.g., XBLAST and NBLAST) can be used (see the world wide web address ncbi.nlm.nih.gov).

A nucleic acid that is substantially identical to a ICAM, MAPK10, KIAA0861, NUMA1 or GALE nucleotide sequence may include polymorphic sites at positions equivalent to those described herein when the sequences are aligned. For example, using the alignment procedures described herein, SNPs in a sequence substantially identical to a sequence in SEQ ID NO: 1-12 can be identified at nucleotide positions that match (i.e., align) with nucleotides at SNP positions in the nucleotide sequence of SEQ ID NO: 1-12. Also, where a polymorphic variation results in an insertion or deletion, insertion or deletion of a nucleotide sequence from a reference sequence can change the relative positions of other polymorphic sites in the nucleotide sequence.

Substantially identical nucleotide and polypeptide sequences include those that are naturally occurring, such as allelic variants (same locus), splice variants, homologs (different locus), and orthologs (different organism) or can be non-naturally occurring. Non-naturally occurring variants can be generated by mutagenesis techniques, including those applied to polynucleotides, cells, or organisms. The variants can contain nucleotide substitutions, deletions, inversions and insertions. Variation can occur in either or both the coding and non-coding regions. The variations can produce both conservative and non-conservative amino acid substitutions (as compared in the encoded product). Orthologs, homologs, allelic variants, and splice variants can be identified using methods known in the art. These variants normally comprise a nucleotide sequence encoding a polypeptide that is 50% or more, about 55% or more, often about 70-75% or more, more often about 80-85% or more, and typically about 90-95% or more identical to the amino acid sequences of target polypeptides or a fragment thereof. Such nucleic acid molecules readily can be identified as being able to hybridize under stringent conditions to a nucleotide sequence in SEQ ID NO: 1-12 or a fragment thereof. Nucleic acid molecules corresponding to orthologs, homologs, and allelic variants of a nucleotide sequence in SEQ ID NO: 1-12 can be identified by mapping the sequence to the same chromosome or locus as the nucleotide sequence in SEQ ID NO: 1-12.

Also, substantially identical nucleotide sequences may include codons that are altered with respect to the naturally occurring sequence for enhancing expression of a target polypeptide in a particular expression system. For example, the nucleic acid can be one in which one or more codons are altered, and often 10% or more or 20% or more of the codons are altered for optimized expression in bacteria (e.g., *E. coli*), yeast (e.g., *S. cervesiae*), human (e.g., 293 cells), insect, or rodent (e.g., hamster) cells.

Methods for Identifying Subjects at Risk of Breast Cancer and Breast Cancer Risk in a Subject Methods for prognosing and diagnosing breast cancer in subjects are provided herein. These methods include detecting the presence or absence of one or more polymorphic variations associated with breast cancer in a nucleotide sequence set forth in SEQ ID NO: 1-5, or substantially identical sequence thereof, in a sample from a subject, where the presence of a polymorphic variant is indicative of a risk of breast cancer.

Thus, featured herein is a method for detecting a subject at risk of breast cancer or the risk of breast cancer in a subject, which comprises detecting the presence or absence of a polymorphic variation associated with breast cancer at a polymorphic site in a nucleic acid sample from a subject, where the nucleotide sequence comprises a polynucleotide sequence selected from the group consisting of: (a) a nucleotide sequence set forth in SEQ ID NO: 1-5; (b) a nucleotide sequence which encodes a polypeptide having an amino acid sequence encoded by a nucleotide sequence in SEQ ID NO: 1-5; (c) a nucleotide sequence which encodes a polypeptide that is 90% or more identical to an amino acid sequence encoded by a nucleotide sequence in SEQ ID NO: 1-5 or a nucleotide sequence about 90% or more identical to the nucleotide sequence set forth in SEQ ID NO: 1-5; and (d) a fragment of a nucleotide sequence of (a), (b), or (c), often a fragment that includes a polymorphic site associated with breast cancer; whereby the presence of the polymorphic variation is indicative of a risk of breast cancer in the subject.

In certain embodiments, determining the presence of a combination of two or more polymorphic variants associated with breast cancer in one or more genetic loci (e.g., one or more genes) of the sample is determined to identify, quantify and/or estimate, risk of breast cancer. The risk often is the probability of having or developing breast cancer. The risk sometimes is expressed as a relative risk with respect to a population average risk of breast cancer, and sometimes is expressed as a relative risk with resepect to the lowest risk group. Such relative risk assessments often are based upon penetrance values determined by statistical methods (see e.g., statistical analysis Example 9), and are particularly useful to clinicians and insurance companies for assessing risk of breast cancer (e.g., a clinician can target appropriate detection, prevention and therapeutic regimens to a partient after determining the patient's risk of breast cancer, and an insurance company can fine tune actuarial tables based upon population genotype assessments of breast cancer risk). Risk of breast cancer sometimes is expressed as an odds ratio, which is the odds of a particular person having a genotype has or will develop breast cancer with respect to another genotype group (e.g., the most disease protective genotype or population average). In related embodiments, the determination is utilized to identify a subject at risk of breast cancer. In an embodiment, two or more polymorphic variations are detected in two or more regions in human genomic DNA associated with increased risk of breast cancer, such as regions selected from the group of loci consisting of ICAM, MAPK10, KIAA0861, NUMA1 and GALE, for example. In certain embodiments, 3 or more, or 4, 5, 6, 7, 8, 9, 10, 11, 12, 13, 14, 15, 16, 17, 18, 19 or 20 or more polymorphic variants are detected in the sample. In specific embodiments, polymorphic variants are detected in ICAM, MAPK10, KIAA0861, NUMA1 and GALE loci, such as at positions 44247 in SEQ ID NO: 1 (ICAM), position 36424 in SEQ ID NO: 2 (MAPK10), position 48563 in SEQ ID NO: 3 (KIAA0861), position 49002 in SEQ ID NO: 4 (NUMA1) and position 174 in SEQ ID NO: 5 (GALE), for example. In certain embodiments, polymorphic variants are detected at other genetic loci (e.g., the polymorphic variants can be detected in ICAM, MAPK10, KIAA0861, NUMA1 and/or GALE in addition to other loci or only in other loci), where the other loci include but are not limited to RAD21, KLF12, SPUVE, GRIN3A, PFTK1, SERPINA5, LOC115209, HRMTIL3, DLG1, KIAA0783, DPF3, CENPC1, GP6, LAMA4, CHCB/C20ORF154, LOC338749, and TTN/LOC351327, which are described in concurrently-filed patent applications having and, and any others disclosed in patent application Nos. 60/429,136 (filed Nov. 25, 2002) 60/490,234 (filed Jul. 24, 2003).

A risk of developing aggressive forms of breast cancer likely to metastasize or invade surrounding tissues (e.g., Stage IIIA, IIIB, and IV breast cancers), and subjects at risk of developing aggressive forms of breast cancer also may be identified by the methods described herein. These methods include collecting phenotype information from subjects having breast cancer, which includes the stage of progression of the breast cancer, and performing a secondary phenotype analysis to detect the presence or absence of one or more polymorphic variations associated with a particular stage form of breast cancer. Thus, detecting the presence or absence of one or more polymorphic variations in a ICAM, MAPK10, KIAA0861, NUMA1 or GALE nucleotide sequence associated with a late stage form of breast cancer often is prognostic and/or diagnostic of an aggressive form of the cancer.

Results from prognostic tests may be combined with other test results to diagnose breast cancer. For example, prognostic results may be gathered, a patient sample may be ordered based on a determined predisposition to breast cancer, the patient sample is analyzed, and the results of the analysis may be utilized to diagnose breast cancer. Also breast cancer diagnostic methods can be developed from studies used to generate prognostic/diagnostic methods in which populations are stratified into subpopulations having different progressions of breast cancer. In another embodiment, prognostic results may be gathered; a patient's risk factors for developing breast cancer analyzed (e.g., age, race, family history, age of first menstrual cycle, age at birth of first child); and a patient sample may be ordered based on a determined predisposition to breast cancer. In an alternative embodiment, the results from predisposition analyses described herein may be combined with other test results indicative of breast cancer, which were previously, concurrently, or subsequently gathered with respect to the predisposition testing. In these embodiments, the combination of the prognostic test results with other test results can be probative of breast cancer, and the combination can be utilized as a breast cancer diagnostic. The results of any test indicative of breast cancer known in the art may be combined with the methods described herein. Examples of such tests are mammography (e.g., a more frequent and/or earlier mammography regimen may be prescribed); breast biopsy and optionally a biopsy from another tissue; breast ultrasound and optionally an ultrasound analysis of another tissue; breast magnetic resonance imaging (MRI) and optionally an MRI analysis of another tissue; electrical impedance (T-scan) analysis of breast and optionally of another tissue; ductal lavage; nuclear medicine analysis (e.g., scintimammography); BRCA1 and/or BRCA2 sequence analysis results; and thermal imaging of the breast and optionally of another tissue. Testing may be performed on tissue other than breast to diagnose the occurrence of metastasis (e.g., testing of the lymph node).

Risk of breast cancer sometimes is expressed as a probability, such as an odds ratio, percentage, or risk factor. The risk is based upon the presence or absence of one or more polymorphic variants described herein, and also may be based in part upon phenotypic traits of the individual being tested. Methods for calculating predispositions based upon patient data are well known (see, e.g., Agresti, *Categorical Data Analysis,* 2nd Ed. 2002. Wiley). Allelotyping and genotyping analyses may be carried out in populations other than those exemplified herein to enhance the predictive power of the prognostic method. These further analyses are executed in view of the exemplified procedures described herein, and may be based upon the same polymorphic variations or additional polymorphic variations. Risk determinations for breast cancer are useful in a variety of applications. In one embodiment, breast cancer risk determinations are used by clinicians to direct appropriate detection, preventative and treatment procedures to subjects who most require these. In another embodiment, breast cancer risk determinations are used by health insurers for preparing actuarial tables and for calculating insurance premiums.

The nucleic acid sample typically is isolated from a biological sample obtained from a subject. For example, nucleic acid can be isolated from blood, saliva, sputum, urine, cell scrapings, and biopsy tissue. The nucleic acid sample can be isolated from a biological sample using standard techniques, such as the technique described in Example 2. As used herein, the term "subject" refers primarily to humans but also refers to other mammals such as dogs, cats, and ungulates (e.g., cattle, sheep, and swine). Subjects also include avians (e.g., chickens and turkeys), reptiles, and fish (e.g., salmon), as embodiments described herein can be adapted to nucleic acid samples isolated from any of these organisms. The nucleic acid sample may be isolated from the subject and then directly utilized in a method for determining the presence of a polymorphic variant, or alternatively, the sample may be isolated and then stored (e.g., frozen) for a period of time before being subjected to analysis.

The presence or absence of a polymorphic variant is determined using one or both chromosomal complements represented in the nucleic acid sample. Determining the presence or absence of a polymorphic variant in both chromosomal complements represented in a nucleic acid sample from a subject having a copy of each chromosome is useful for determining the zygosity of an individual for the polymorphic variant (i.e., whether the individual is homozygous or heterozygous for the polymorphic variant). Any oligonucleotide-based diagnostic may be utilized to determine whether a sample includes the presence or absence of a polymorphic variant in a sample. For example, primer extension methods, ligase sequence determination methods (e.g., U.S. Pat. Nos. 5,679,524 and 5,952,174, and WO 01/27326), mismatch sequence determination methods (e.g., U.S. Pat. Nos. 5,851, 770; 5,958,692; 6,110,684; and 6,183,958), microarray sequence determination methods, restriction fragment length polymorphism (RFLP), single strand conformation polymorphism detection (SSCP) (e.g., U.S. Pat. Nos. 5,891,625 and 6,013,499), PCR-based assays (e.g., TAQMAN® PCR System (Applied Biosystems)), and nucleotide sequencing methods may be used.

Oligonucleotide extension methods typically involve providing a pair of oligonucleotide primers in a polymerase chain reaction (PCR) or in other nucleic acid amplification methods for the purpose of amplifying a region from the nucleic acid sample that comprises the polymorphic variation. One oligonucleotide primer is complementary to a region 3' of the polymorphism and the other is complementary to a region 5' of the polymorphism. A PCR primer pair may be used in methods disclosed in U.S. Pat. Nos. 4,683, 195; 4,683,202, 4,965,188; 5,656,493; 5,998,143; 6,140,054; WO 01/27327; and WO 01/27329 for example. PCR primer pairs may also be used in any commercially available machines that perform PCR, such as any of the GENEAMP® Systems available from Applied Biosystems. Also, those of ordinary skill in the art will be able to design oligonucleotide primers based upon a nucleotide sequence set forth in SEQ ID NO: 1-5 without undue experimentation using knowledge readily available in the art.

Also provided is an extension oligonucleotide that hybridizes to the amplified fragment adjacent to the polymorphic variation. As used herein, the term "adjacent" refers to the 3' end of the extension oligonucleotide being often 1 nucleotide from the 5' end of the polymorphic site, and sometimes 2, 3, 4, 5, 6, 7, 8, 9, or 10 nucleotides from the 5' end of the polymorphic site, in the nucleic acid when the extension oligonucleotide is hybridized to the nucleic acid. The extension oligonucleotide then is extended by one or more nucleotides, and the number and/or type of nucleotides that are added to the extension oligonucleotide determine whether the polymorphic variant is present. Oligonucleotide extension methods are disclosed, for example, in U.S. Pat. Nos. 4,656, 127; 4,851,331; 5,679,524; 5,834,189; 5,876,934; 5,908,755; 5,912,118; 5,976,802; 5,981,186; 6,004,744; 6,013,431; 6,017,702; 6,046,005; 6,087,095; 6,210,891; and WO 01/20039. Oligonucleotide extension methods using mass spectrometry are described, for example, in U.S. Pat. Nos. 5,547,835; 5,605,798; 5,691,141; 5,849,542; 5,869,242; 5,928,906; 6,043,031; and 6,194,144, and a method often utilized is described herein in Example 2. Multiple extension oligonucleotides may be utilized in one reaction, which is referred to herein as "multiplexing."

A microarray can be utilized for determining whether a polymorphic variant is present or absent in a nucleic acid sample. A microarray may include any oligonucleotides described herein, and methods for making and using oligonucleotide microarrays suitable for diagnostic use are disclosed in U.S. Pat. Nos. 5,492,806; 5,525,464; 5,589,330; 5,695,940; 5,849,483; 6,018,041; 6,045,996; 6,136,541; 6,142,681; 6,156,501; 6,197,506; 6,223,127; 6,225,625; 6,229,911; 6,239,273; WO 00/52625; WO 01/25485; and WO 01/29259. The microarray typically comprises a solid support and the oligonucleotides may be linked to this solid support by covalent bonds or by non-covalent interactions. The oligonucleotides may also be linked to the solid support directly or by a spacer molecule. A microarray may comprise one or more oligonucleotides complementary to a polymorphic site set forth in SEQ ID NO: 1-5 or below.

A kit also may be utilized for determining whether a polymorphic variant is present or absent in a nucleic acid sample. A kit often comprises one or more pairs of oligonucleotide primers useful for amplifying a fragment of a ICAM, MAPK10, KIAA0861, NUMA1 or GALE nucleotide sequence or a substantially identical sequence thereof, where the fragment includes a polymorphic site. The kit sometimes comprises a polymerizing agent, for example, a thermostable nucleic acid polymerase such as one disclosed in U.S. Pat. Nos. 4,889,818 or 6,077,664. Also, the kit often comprises an elongation oligonucleotide that hybridizes to a ICAM, MAPK10, KIAA0861, NUMA1 or GALE nucleotide sequence in a nucleic acid sample adjacent to the polymorphic site. Where the kit includes an elongation oligonucleotide, it also often comprises chain elongating nucleotides, such as dATP, dTTP, dGTP, dCTP, and dITP, including analogs of dATP, dTTP, dGTP, dCTP and dITP, provided that such analogs are substrates for a thermostable nucleic acid polymerase and can be incorporated into a nucleic acid chain elongated from the extension oligonucleotide. Along with chain elongating nucleotides would be one or more chain terminating nucleotides such as ddATP, ddTTP, ddGTP, ddCTP, and the like. In an embodiment, the kit comprises one or more oligonucleotide primer pairs, a polymerizing agent, chain elongating nucleotides, at least one elongation oligonucleotide, and one or more chain terminating nucleotides. Kits optionally include buffers, vials, microtiter plates, and instructions for use.

An individual identified as being at risk of breast cancer may be heterozygous or homozygous with respect to the allele associated with a higher risk of breast cancer. A subject homozygous for an allele associated with an increased risk of breast cancer is at a comparatively high risk of breast cancer, a subject heterozygous for an allele associated with an increased risk of breast cancer is at a comparatively intermediate risk of breast cancer, and a subject homozygous for an allele associated with a decreased risk of breast cancer is at a comparatively low risk of breast cancer. A genotype may be assessed for a complementary strand, such that the complementary nucleotide at a particular position is detected.

Also featured are methods for determining risk of breast cancer and/or identifying a subject at risk of breast cancer by contacting a polypeptide or protein encoded by a ICAM, MAPK10, KIAA0861, NUMA1 or GALE nucleotide sequence from a subject with an antibody that specifically binds to an epitope associated with increased risk of breast cancer in the polypeptide. In certain embodiments, the antibody specifically binds to an epitope that comprises a leucine at amino acid position 359 in SEQ ID NO: 17, a leucine at amino acid position 378 in SEQ ID NO: 17, or an alanine at amino acid position 857 in SEQ ID NO: 17, a proline at amino acid position 352 in SEQ ID NO: 15 or an alanine at amino acid position 348 in SEQ ID NO: 15.

Applications of Prognostic and Diagnostic Results to Pharmacogenomic Methods

Pharmacogenomics is a discipline that involves tailoring a treatment for a subject according to the subject's genotype. For example, based upon the outcome of a prognostic test described herein, a clinician or physician may target pertinent information and preventative or therapeutic treatments to a subject who would be benefited by the information or treatment and avoid directing such information and treatments to a subject who would not be benefited (e.g., the treatment has no therapeutic effect and/or the subject experiences adverse side effects). As therapeutic approaches for breast cancer continue to evolve and improve, the goal of treatments for breast cancer related disorders is to intervene even before clinical signs (e.g., identification of lump in the breast) first manifest. Thus, genetic markers associated with susceptibility to breast cancer prove useful for early diagnosis, prevention and treatment of breast cancer.

The following is an example of a pharmacogenomic embodiment. A particular treatment regimen can exert a differential effect depending upon the subject's genotype. Where a candidate therapeutic exhibits a significant interaction with a major allele and a comparatively weak interaction with a minor allele (e.g., an order of magnitude or greater difference in the interaction), such a therapeutic typically would not be administered to a subject genotyped as being homozygous for the minor allele, and sometimes not administered to a subject genotyped as being heterozygous for the minor allele. In another example, where a candidate therapeutic is not significantly toxic when administered to subjects who are homozygous for a major allele but is comparatively toxic when administered to subjects heterozygous or homozygous for a minor allele, the candidate therapeutic is not typically administered to subjects who are genotyped as being heterozygous or homozygous with respect to the minor allele.

The methods described herein are applicable to pharmacogenomic methods for detecting, preventing, alleviating and/or treating breast cancer. For example, a nucleic acid sample from an individual may be subjected to a genetic test described herein. Where one or more polymorphic variations associated with increased risk of breast cancer are identified in a subject, information for detecting, preventing or treating breast cancer and/or one or more breast cancer detection, prevention and/or treatment regimens then may be directed to and/or prescribed to that subject.

In certain embodiments, a detection, prevenative and/or treatment regimen is specifically prescribed and/or administered to individuals who will most benefit from it based upon their risk of developing breast cancer assessed by the methods described herein. Thus, provided are methods for identifying a subject at risk of breast cancer and then prescribing a detection, therapeutic or preventative regimen to individuals identified as being at risk of breast cancer. Thus, certain embodiments are directed to methods for treating breast cancer in a subject, reducing risk of breast cancer in a subject, or early detection of breast cancer in a subject, which comprise: detecting the presence or absence of a polymorphic variant associated with breast cancer in a nucleotide sequence in a nucleic acid sample from a subject, where the nucleotide sequence comprises a polynucleotide sequence selected from the group consisting of: (a) a nucleotide sequence set forth in SEQ ID NO: 1-5; (b) a nucleotide sequence which encodes a polypeptide having an amino acid sequence encoded by a nucleotide sequence in SEQ ID NO: 1-5; (c) a nucleotide sequence which encodes a polypeptide that is 90% or more identical to an amino acid sequence encoded by a nucleotide sequence in SEQ ID NO: 1-5 or a nucleotide sequence about 90% or more identical to the nucleotide sequence set forth in SEQ ID NO: 1-5; and (d) a fragment of a nucleotide sequence of (a), (b), or (c), sometimes comprising a polymorphic site associated with breast cancer; and prescribing or administering a breast cancer treatment regimen, preventative regimen and/or detection regimen to a subject from whom the sample originated where the presence of one or more polymorphic variations associated with breast cancer are detected in the nucleotide sequence. In these methods, genetic results may be utilized in combination with other test results to diagnose breast cancer as described above. Other test results include but are not limited to mammography results, imaging results, biopsy results and results from BRCA1 or BRAC2 test results, as described above.

Detection regimens include one or more mammography procedures, a regular mammography regimen (e.g., once a year, or once every six, four, three or two months); an early mammography regimen (e.g., mammography tests are performed beginning at age 25, 30, or 35); one or more biopsy procedures (e.g., a regular biopsy regimen beginning at age 40); breast biopsy and biopsy from other tissue; breast ultrasound and optionally ultrasound analysis of another tissue; breast magnetic resonance imaging (MRI) and optionally MRI analysis of another tissue; electrical impedance (T-scan) analysis of breast and optionally another tissue; ductal lavage; nuclear medicine analysis (e.g., scintimammography); BRCA1 and/or BRCA2 sequence analysis results; and/or thermal imaging of the breast and optionally another tissue.

Treatments sometimes are preventative (e.g., is prescribed or administered to reduce the probability that a breast cancer associated condition arises or progresses), sometimes are therapeutic, and sometimes delay, alleviate or halt the progression of breast cancer. Any known preventative or therapeutic treatment for alleviating or preventing the occurrence of breast cancer is prescribed and/or administered. For example, certain preventative treatments often are prescribed to subjects having a predisposition to breast cancer and where the subject is not diagnosed with breast cancer or is diagnosed as having symptoms indicative of early stage breast cancer (e.g., stage I). For subjects not diagnosed as having breast cancer, any preventative treatments known in the art can be prescribed and administered, which include selective hormone receptor modulators (e.g., selective estrogen receptor modulators (SERMs) such as tamoxifen, reloxifene, and toremifene); compositions that prevent production of hormones (e.g., aramotase inhibitors that prevent the production of estrogen in the adrenal gland, such as exemestane, letrozole, anastrozol, groserelin, and megestrol); other hormonal treatments (e.g., goserelin acetate and fulvestrant); biologic response modifiers such as antibodies (e.g., trastuzumab (herceptin/HER2)); surgery (e.g., lumpectomy and mastectomy); drugs that delay or halt metastasis (e.g., pamidronate disodium); and alternative/complementary medicine (e.g., acupuncture, acupressure, moxibustion, qi gong, reiki, ayurveda, vitamins, minerals, and herbs (e.g., astragalus root, burdock root, garlic, green tea, and licorice root)).

The use of breast cancer treatments are well known in the art, and include surgery, chemotherapy and/or radiation therapy. Any of the treatments may be used in combination to treat or prevent breast cancer (e.g., surgery followed by radiation therapy or chemotherapy). Examples of chemotherapy combinations used to treat breast cancer include: cyclophosphamide (Cytoxan), methotrexate (Amethopterin, Mexate, Folex), and fluorouracil (Fluorouracil, 5-Fu, Adrucil), which is referred to as CMF; cyclophosphamide, doxorubicin (Adriamycin), and fluorouracil, which is referred to as CAF; and doxorubicin (Adriamycin) and cyclophosphamide, which is referred to as AC.

As breast cancer preventative and treatment information can be specifically targeted to subjects in need thereof (e.g., those at risk of developing breast cancer or those that have early signs of breast cancer), provided herein is a method for preventing or reducing the risk of developing breast cancer in a subject, which comprises: (a) detecting the presence or absence of a polymorphic variation associated with breast cancer at a polymorphic site in a nucleotide sequence in a nucleic acid sample from a subject; (b) identifying a subject with a predisposition to breast cancer, whereby the presence of the polymorphic variation is indicative of a predisposition to breast cancer in the subject; and (c) if such a predisposition is identified, providing the subject with information about methods or products to prevent or reduce breast cancer or to delay the onset of breast cancer. Also provided is a method of targeting information or advertising to a subpopulation of a human population based on the subpopulation being genetically predisposed to a disease or condition, which comprises: (a) detecting the presence or absence of a polymorphic variation associated with breast cancer at a polymorphic site in a nucleotide sequence in a nucleic acid sample from a subject; (b) identifying the subpopulation of subjects in which the polymorphic variation is associated with breast cancer; and (c) providing information only to the subpopulation of subjects about a particular product which may be obtained and consumed or applied by the subject to help prevent or delay onset of the disease or condition.

Pharmacogenomics methods also may be used to analyze and predict a response to a breast cancer treatment or a drug. For example, if pharmacogenomics analysis indicates a likelihood that an individual will respond positively to a breast cancer treatment with a particular drug, the drug may be administered to the individual. Conversely, if the analysis indicates that an individual is likely to respond negatively to treatment with a particular drug, an alternative course of treatment may be prescribed. A negative response may be defined as either the absence of an efficacious response or the presence of toxic side effects. The response to a therapeutic treatment can be predicted in a background study in which subjects in any of the following populations are genotyped: a population that responds favorably to a treatment regimen, a population that does not respond significantly to a treatment regimen, and a population that responds adversely to a treatment regiment (e.g., exhibits one or more side effects). These populations are provided as examples and other populations and subpopulations may be analyzed. Based upon the results of these analyses, a subject is genotyped to predict whether he or she will respond favorably to a treatment regimen, not respond significantly to a treatment regimen, or respond adversely to a treatment regimen.

The methods described herein also are applicable to clinical drug trials. One or more polymorphic variants indicative of response to an agent for treating breast cancer or to side effects to an agent for treating breast cancer may be identified using the methods described herein. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems. In certain embodiments, the agent for treating breast cancer described herein targets ICAM, MAPK10, KIAA0861, NUMA1 or GALE or a target in the ICAM, MAPK10, KIAA0861, NUMA1 or GALE pathway.

Thus, another embodiment is a method of selecting an individual for inclusion in a clinical trial of a treatment or drug comprising the steps of: (a) obtaining a nucleic acid sample from an individual; (b) determining the identity of a polymorphic variation which is associated with a positive response to the treatment or the drug, or at least one polymorphic variation which is associated with a negative response to the treatment or the drug in the nucleic acid sample, and (c) including the individual in the clinical trial if the nucleic acid sample contains said polymorphic variation associated with a positive response to the treatment or the drug or if the nucleic acid sample lacks said polymorphic variation associated with a negative response to the treatment or the drug. In addition, the methods for selecting an individual for inclusion in a clinical trial of a treatment or drug encompass methods with any further limitation described in this disclosure, or those following, specified alone or in any combination. The polymorphic variation may be in a sequence selected individually or in any combination from the group consisting of (i) a polynucleotide sequence set forth in SEQ ID NO: 1-5; (ii) a polynucleotide sequence that is 90% or more identical to a nucleotide sequence set forth in SEQ ID NO: 1-5; (iii) a polynucleotide sequence that encodes a polypeptide having an amino acid sequence identical to or 90% or more identical to an amino acid sequence encoded by a nucleotide sequence set forth in SEQ ID NO: 1-5; and (iv) a fragment of a polynucleotide sequence of (i), (ii), or (iii) comprising the polymorphic site. The including step (c) optionally comprises administering the drug or the treatment to the individual if the nucleic acid sample contains the polymorphic variation associated with a positive response to the treatment or the drug and the nucleic acid sample lacks said biallelic marker associated with a negative response to the treatment or the drug.

Also provided herein is a method of partnering between a diagnostic/prognostic testing provider and a provider of a consumable product, which comprises: (a) the diagnostic/prognostic testing provider detects the presence or absence of a polymorphic variation associated with breast cancer at a polymorphic site in a nucleotide sequence in a nucleic acid sample from a subject; (b) the diagnostic/prognostic testing provider identifies the subpopulation of subjects in which the polymorphic variation is associated with breast cancer; (c) the diagnostic/prognostic testing provider forwards information to the subpopulation of subjects about a particular product which may be obtained and consumed or applied by the subject to help prevent or delay onset of the disease or condition; and (d) the provider of a consumable product forwards to the diagnostic test provider a fee every time the diagnostic/prognostic test provider forwards information to the subject as set forth in step (c) above.

Compositions Comprising Breast Cancer-Directed Molecules

Featured herein is a composition comprising a breast cancer cell and one or more molecules specifically directed and targeted to a nucleic acid comprising a ICAM, MAPK10, KIAA0861, NUMA1 or GALE nucleotide sequence or a ICAM, MAPK10, KIAA0861, NUMA1 or GALE polypeptide. Such directed molecules include, but are not limited to, a compound that binds to a ICAM, MAPK10, KIAA0861, NUMA1 or GALE nucleic acid or a ICAM, MAPK10, KIAA0861, NUMA1 or GALE polypeptide; a RNAi or siRNA molecule having a strand complementary to a ICAM, MAPK10, KIAA0861, NUMA1 or GALE nucleotide sequence; an antisense nucleic acid complementary to an RNA encoded by a ICAM, MAPK10, KIAA0861, NUMA1 or GALE DNA sequence; a ribozyme that hybridizes to a ICAM, MAPK10, KIAA0861, NUMA1 or GALE nucleotide sequence; a nucleic acid aptamer that specifically binds a ICAM, MAPK10, KIAA0861, NUMA1 or GALE polypeptide; and an antibody that specifically binds to a ICAM, MAPK10, KIAA0861, NUMA1 or GALE polypeptide or binds to a ICAM, MAPK10, KIAA0861, NUMA1 or GALE nucleic acid. In certain embodiments, the antibody specifically binds to an epitope that comprises a leucine at amino acid position 359 in SEQ ID NO: 17, a leucine at amino acid position 378 in SEQ ID NO: 17, or an alanine at amino acid position 857 in SEQ ID NO: 17, a proline at amino acid position 352 in SEQ ID NO: 15 or an alanine at amino acid position 348 in SEQ ID NO: 15. In specific embodiments, the breast cancer directed molecule interacts with a ICAM, MAPK10, KIAA0861, NUMA1 or GALE nucleic acid or polypeptide variant associated with breast cancer. In other embodiments, the breast cancer directed molecule interacts with a polypeptide involved in the ICAM, MAPK10, KIAA0861, NUMA1 or GALE signal pathway, or a nucleic acid encoding such a polypeptide. Polypeptides involved in the ICAM, MAPK10, KIAA0861, NUMA1 or GALE signal pathway are discussed herein.

Compositions sometimes include an adjuvant known to stimulate an immune response, and in certain embodiments, an adjuvant that stimulates a T-cell lymphocyte response. Adjuvants are known, including but not limited to an aluminum adjuvant (e.g., aluminum hydroxide); a cytokine adjuvant or adjuvant that stimulates a cytokine response (e.g., interleukin (IL)-12 and/or γ-interferon cytokines); a Freund-type mineral oil adjuvant emulsion (e.g., Freund's complete or incomplete adjuvant); a synthetic lipoid compound; a copolymer adjuvant (e.g., TitreMax); a saponin; Quil A; a liposome; an oil-in-water emulsion (e.g., an emulsion stabilized by Tween 80 and pluronic polyoxyethlene/polyoxypropylene block copolymer (Syntex Adjuvant Formulation); TitreMax; detoxified endotoxin (MPL) and mycobacterial cell wall components (TDW, CWS) in 2% squalene (Ribi Adjuvant System)); a muramyl dipeptide; an immune-stimulating complex (ISCOM, e.g., an Ag-modified saponin/cholesterol micelle that forms stable cage-like structure); an aqueous phase adjuvant that does not have a depot effect (e.g., Gerbu adjuvant); a carbohydrate polymer (e.g., AdjuPrime); L-tyrosine; a manide-oleate compound (e.g., Montanide); an ethylene-vinyl acetate copolymer (e.g., Elvax 40W1,2); or lipid A, for example. Such compositions are useful for generating an immune response against a breast cancer directed molecule (e.g., an HLA-binding subsequence within a polypeptide encoded by a nucleotide sequence in SEQ ID NO: 1). In such methods, a peptide having an amino acid subsequence of a polypeptide encoded by a nucleotide sequence in SEQ ID NO: 1-5 is delivered to a subject, where the subsequence binds to an HLA molecule and induces a CTL lymphocyte response. The peptide sometimes is delivered to the subject as an isolated peptide or as a minigene in a plasmid that encodes the peptide. Methods for identifying HLA-binding subsequences in such polypeptides are known (see e.g., publication WO02/20616 and PCT application US98/01373 for methods of identifying such sequences).

The breast cancer cell may be in a group of breast cancer cells and/or other types of cells cultured in vitro or in a tissue having breast cancer cells (e.g., a melanocytic lesion) maintained in vitro or present in an animal in vivo (e.g., a rat, mouse, ape or human). In certain embodiments, a composition comprises a component from a breast cancer cell or from a subject having a breast cancer cell instead of the breast cancer cell or in addition to the breast cancer cell, where the component sometimes is a nucleic acid molecule (e.g., genomic DNA), a protein mixture or isolated protein, for example. The aforementioned compositions have utility in diagnostic, prognostic and pharmacogenomic methods described previously and in breast cancer therapeutics described hereafter. Certain breast cancer molecules are described in greater detail below.

Compounds

Compounds can be obtained using any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive (see, e.g., Zuckermann et al., J. Med. Chem. 37: 2678-85 (1994)); spatially addressable parallel solid phase or solution phase libraries; synthetic library methods requiring deconvolution; "one-bead one-compound" library methods; and synthetic library methods using affinity chromatography selection. Biological library and peptoid library approaches are typically limited to peptide libraries, while the other approaches are applicable to peptide, non-peptide oligomer or small molecule libraries of compounds (Lam, Anticancer Drug Des. 12: 145, (1997)). Examples of methods for synthesizing molecular libraries are described, for example, in DeWitt et al., Proc. Natl. Acad. Sci. U.S.A. 90: 6909 (1993); Erb et al., Proc. Natl. Acad. Sci. USA 91: 11422 (1994); Zuckermann et al., J. Med. Chem. 37: 2678 (1994); Cho et al., Science 261: 1303 (1993); Carrell et al., Angew. Chem. Int. Ed. Engl. 33: 2059 (1994); Carell et al., Angew. Chem. Int. Ed. Engl. 33: 2061 (1994); and in Gallop et al., J. Med. Chem. 37: 1233 (1994).

Libraries of compounds may be presented in solution (e.g., Houghten, Biotechniques 13: 412-421 (1992)), or on beads (Lam, Nature 354: 82-84 (1991)), chips (Fodor, Nature 364: 555-556 (1993)), bacteria or spores (Ladner, U.S. Pat. No. 5,223,409), plasmids (Cull et al., Proc. Natl. Acad. Sci. USA 89: 1865-1869 (1992)) or on phage (Scott and Smith, Science 249: 386-390 (1990); Devlin, Science 249: 404-406 (1990); Cwirla et al., Proc. Natl. Acad. Sci. 87: 6378-6382 (1990); Felici, J. Mol. Biol. 222: 301-310 (1991); Ladner supra.).

A compound sometimes alters expression and sometimes alters activity of a ICAM, MAPK10, KIAA0861, NUMA1 or GALE polypeptide and may be a small molecule. Small molecules include, but are not limited to, peptides, peptidomimetics (e.g., peptoids), amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

Antisense Nucleic Acid Molecules, Ribozymes, RNAi, siRNA and Modified Nucleic Acid Molecules An "antisense" nucleic acid refers to a nucleotide sequence complementary to a "sense" nucleic acid encoding a polypeptide, e.g., complementary to the coding strand of a double-stranded cDNA molecule or complementary to an mRNA sequence. The antisense nucleic acid can be complementary to an entire coding strand in SEQ ID NO: 1-12, or to a portion thereof or a substantially identical sequence thereof. In another embodiment, the antisense nucleic acid molecule is antisense to a "noncoding region" of the coding strand of a nucleotide sequence in SEQ ID NO: 1-12 (e.g., 5' and 3' untranslated regions).

An antisense nucleic acid can be designed such that it is complementary to the entire coding region of an mRNA encoded by a nucleotide sequence in SEQ ID NO: 1-4 (e.g., SEQ ID NO: 6-12), and often the antisense nucleic acid is an oligonucleotide antisense to only a portion of a coding or noncoding region of the mRNA. For example, the antisense oligonucleotide can be complementary to the region surrounding the translation start site of the mRNA, e.g., between the −10 and +10 regions of the target gene nucleotide sequence of interest. An antisense oligonucleotide can be, for example, about 7, 10, 15, 20, 25, 30, 35, 40, 45, 50, 55, 60, 65, 70, 75, 80, or more nucleotides in length. The antisense nucleic acids, which include the ribozymes described hereafter, can be designed to target a nucleotide sequence in SEQ ID NO: 1-12, often a variant associated with breast cancer, or a substantially identical sequence thereof. Among the variants, minor alleles and major alleles can be targeted, and those associated with a higher risk of breast cancer are often designed, tested, and administered to subjects.

An antisense nucleic acid can be constructed using chemical synthesis and enzymatic ligation reactions using standard procedures. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Antisense nucleic acid also can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

When utilized as therapeutics, antisense nucleic acids typically are administered to a subject (e.g., by direct injection at a tissue site) or generated in situ such that they hybridize with or bind to cellular mRNA and/or genomic DNA encoding a polypeptide and thereby inhibit expression of the polypeptide, for example, by inhibiting transcription and/or translation. Alternatively, antisense nucleic acid molecules can be modified to target selected cells and then are administered systemically. For systemic administration, antisense molecules can be modified such that they specifically bind to receptors or antigens expressed on a selected cell surface, for example, by linking antisense nucleic acid molecules to peptides or antibodies which bind to cell surface receptors or antigens. Antisense nucleic acid molecules can also be delivered to cells using the vectors described herein. Sufficient intracellular concentrations of antisense molecules are achieved by incorporating a strong promoter, such as a pol II or pol III promoter, in the vector construct.

Antisense nucleic acid molecules sometimes are *-anomeric nucleic acid molecules. An *-anomeric nucleic acid molecule forms specific double-stranded hybrids with complementary RNA in which, contrary to the usual *-units, the strands run parallel to each other (Gaultier et al., Nucleic Acids. Res. 15: 6625-6641 (1987)). Antisense nucleic acid molecules can also comprise a 2'-o-methylribonucleotide (Inoue et al., Nucleic Acids Res. 15: 6131-6148 (1987)) or a chimeric RNA-DNA analogue (Inoue et al., FEBS Lett. 215: 327-330 (1987)). Antisense nucleic acids sometimes are composed of DNA or PNA or any other nucleic acid derivatives described previously.

In another embodiment, an antisense nucleic acid is a ribozyme. A ribozyme having specificity for a ICAM, MAPK10, KIAA0861, NUMA1 or GALE nucleotide sequence can include one or more sequences complementary to such a nucleotide sequence, and a sequence having a known catalytic region responsible for mRNA cleavage (see e.g., U.S. Pat. No. 5,093,246 or Haselhoff and Gerlach, Nature 334: 585-591 (1988)). For example, a derivative of a Tetrahymena L-19 IVS RNA is sometimes utilized in which the nucleotide sequence of the active site is complementary to the nucleotide sequence to be cleaved in a mRNA (see e.g., Cech et al. U.S. Pat. No. 4,987,071; and Cech et al. U.S. Pat. No. 5,116,742). Also, target mRNA sequences can be used to select a catalytic RNA having a specific ribonuclease activity from a pool of RNA molecules (see e.g., Bartel & Szostak, Science 261: 1411-1418 (1993)).

Breast cancer directed molecules include in certain embodiments nucleic acids that can form triple helix structures with a ICAM, MAPK10, KIAA0861, NUMA1 or GALE nucleotide sequence or a substantially identical sequence thereof, especially one that includes a regulatory region that controls expression of a polypeptide. Gene expression can be inhibited by targeting nucleotide sequences complementary to the regulatory region of a ICAM, MAPK10, KIAA0861, NUMA1 or GALE nucleotide sequence or a substantially identical sequence (e.g., promoter and/or enhancers) to form triple helical structures that prevent transcription of a gene in target cells (see e.g., Helene, Anti-cancer Drug Des. 6(6): 569-84 (1991); Helene et al., Ann. N.Y. Acad. Sci. 660: 27-36 (1992); and Maher, Bioassays 14(12): 807-15 (1992). Potential sequences that can be targeted for triple helix formation can be increased by creating a so-called "switchback" nucleic acid molecule. Switchback molecules are synthesized in an alternating 5'-3',3'-5' manner, such that they base pair with first one strand of a duplex and then the other, eliminating the necessity for a sizeable stretch of either purines or pyrimidines to be present on one strand of a duplex.

Breast cancer directed molecules include RNAi and siRNA nucleic acids. Gene expression may be inhibited by the introduction of double-stranded RNA (dsRNA), which induces potent and specific gene silencing, a phenomenon called RNA interference or RNAi. See, e.g., Fire et al., U.S. Pat. No. 6,506,559; Tuschl et al. PCT International Publication No. WO 01/75164; Kay et al. PCT International Publication No. WO 03/010180A1; or Bosher J M, Labouesse, Nat Cell Biol 2000 February; 2(2):E31-6. This process has been improved by decreasing the size of the double-stranded RNA to 20-24 base pairs (to create small-interfering RNAs or siRNAs) that "switched off" genes in mammalian cells without initiating an acute phase response, i.e., a host defense mechanism that often results in cell death (see, e.g., Caplen et al. Proc Natl Acad Sci USA. 2001 Aug. 14; 98(17):9742-7 and Elbashir et al. Methods 2002 February; 26(2):199-213). There is increasing evidence of post-transcriptional gene silencing by RNA interference (RNAi) for inhibiting targeted expression in mammalian cells at the mRNA level, in human cells. There is additional evidence of effective methods for inhibiting the proliferation and migration of tumor cells in human patients, and for inhibiting metastatic cancer development (see, e.g., U.S. Patent Application No. U.S. 2001000993183; Caplen et al. Proc Natl Acad Sci USA; and Abderrahmani et al. Mol Cell Biol 2001 November 21 (21):7256-67).

An "siRNA" or "RNAi" refers to a nucleic acid that forms a double stranded RNA and has the ability to reduce or inhibit expression of a gene or target gene when the siRNA is delivered to or expressed in the same cell as the gene or target gene. "siRNA" refers to short double-stranded RNA formed by the complementary strands. Complementary portions of the siRNA that hybridize to form the double stranded molecule often have substantial or complete identity to the target molecule sequence. In one embodiment, an siRNA refers to a nucleic acid that has substantial or complete identity to a target gene and forms a double stranded siRNA.

When designing the siRNA molecules, the targeted region often is selected from a given DNA sequence beginning 50 to 100 nucleotides downstream of the start codon. See, e.g., Elbashir et al,. Methods 26: 199-213 (2002). Initially, 5' or 3' UTRs and regions nearby the start codon were avoided assuming that UTR-binding proteins and/or translation initiation complexes may interfere with binding of the siRNP or RISC endonuclease complex. Sometimes regions of the target 23 nucleotides in length conforming to the sequence motif AA(N19)TT (SEQ ID NO: 835)(N, any nucleotide), and regions with approximately 30% to 70% G/G-content (often about 50% G/C-content) often are selected. If no suitable sequences are found, the search often is extended using the motif NA(N21). The sequence of the sense siRNA sometimes corresponds to (N19) TT or N21 (position 3 to 23 of the 23-nt motif), respectively. In the latter case, the 3' end of the sense siRNA often is converted to TT. The rationale for this sequence conversion is to generate a symmetric duplex with respect to the sequence composition of the sense and antisense 3' overhangs. The antisense siRNA is synthesized as the complement to position 1 to 21 of the 23-nt motif. Because position 1 of the 23-nt motif is not recognized sequence-specifically by the antisense siRNA, the 3'-most nucleotide residue of the antisense siRNA can be chosen deliberately. However, the penultimate nucleotide of the antisense siRNA (complementary to position 2 of the 23-nt motif) often is complementary to the targeted sequence. For simplifying chemical synthesis, TT often is utilized. siRNAs corresponding to the target motif NAR(N17)YNN, where R is purine (A,G) and Y is pyrimidine (C,U), often are selected. Respective 21 nucleotide sense and antisense siRNAs often begin with a purine nucleotide and can also be expressed from pol III expression vectors without a change in targeting site. Expression of RNAs from pol III promoters often is efficient when the first transcribed nucleotide is a purine.

The sequence of the siRNA can correspond to the full length target gene, or a subsequence thereof. Often, the siRNA is about 15 to about 50 nucleotides in length (e.g., each complementary sequence of the double stranded siRNA is 15-50 nucleotides in length, and the double stranded siRNA is about 15-50 base pairs in length, sometimes about 20-30 nucleotides in length or about 20-25 nucleotides in length, e.g., 20, 21, 22, 23, 24, 25, 26, 27, 28, 29, or 30 nucleotides in length. The siRNA sometimes is about 21 nucleotides in length. Methods of using siRNA are well known in the art, and specific siRNA molecules may be purchased from a number of companies including Dharmacon Research, Inc.

Antisense, ribozyme, RNAi and siRNA nucleic acids can be altered to form modified nucleic acid molecules. The nucleic acids can be altered at base moieties, sugar moieties or phosphate backbone moieties to improve stability, hybridization, or solubility of the molecule. For example, the deoxyribose phosphate backbone of nucleic acid molecules can be modified to generate peptide nucleic acids (see Hyrup et al., Bioorganic & Medicinal Chemistry 4 (1): 5-23 (1996)). As used herein, the terms "peptide nucleic acid" or "PNA" refers to a nucleic acid mimic such as a DNA mimic, in which the deoxyribose phosphate backbone is replaced by a pseudopeptide backbone and only the four natural nucleobases are retained. The neutral backbone of a PNA can allow for specific hybridization to DNA and RNA under conditions of low ionic strength. Synthesis of PNA oligomers can be performed using standard solid phase peptide synthesis protocols as described, for example, in Hyrup et al., (1996) supra and Perry-O'Keefe et al., Proc. Natl. Acad. Sci. 93: 14670-675 (1996).

PNA nucleic acids can be used in prognostic, diagnostic, and therapeutic applications. For example, PNAs can be used as antisense or antigene agents for sequence-specific modulation of gene expression by, for example, inducing transcription or translation arrest or inhibiting replication. PNA nucleic acid molecules can also be used in the analysis of single base pair mutations in a gene, (e.g., by PNA-directed PCR clamping); as "artificial restriction enzymes" when used in combination with other enzymes, (e.g., S1 nucleases (Hyrup (1996) supra)); or as probes or primers for DNA sequencing or hybridization (Hyrup et al., (1996) supra; Perry-O'Keefe supra).

In other embodiments, oligonucleotides may include other appended groups such as peptides (e.g., for targeting host cell receptors in vivo), or agents facilitating transport across cell membranes (see e.g., Letsinger et al., Proc. Natl. Acad. Sci. USA 86: 6553-6556 (1989); Lemaitre et al., Proc. Natl. Acad. Sci. USA 84: 648-652 (1987); PCT Publication No. WO88/09810) or the blood-brain barrier (see, e.g., PCT Publication No. WO89/10134). In addition, oligonucleotides can be modified with hybridization-triggered cleavage agents (See, e.g., Krol et al., Bio-Techniques 6: 958-976 (1988)) or intercalating agents. (See, e.g., Zon, Pharm. Res. 5: 539-549 (1988)). To this end, the oligonucleotide may be conjugated to another molecule, (e.g., a peptide, hybridization triggered cross-linking agent, transport agent, or hybridization-triggered cleavage agent).

Also included herein are molecular beacon oligonucleotide primer and probe molecules having one or more regions complementary to a nucleotide sequence of SEQ ID NO: 1-12 or a substantially identical sequence thereof, two complementary regions one having a fluorophore and one a quencher such that the molecular beacon is useful for quantifying the presence of the nucleic acid in a sample. Molecular beacon nucleic acids are described, for example, in Lizardi et al., U.S. Pat. No. 5,854,033; Nazarenko et al., U.S. Pat. No. 5,866,336, and Livak et al., U.S. Pat. No. 5,876,930.

Antibodies

The term "antibody" as used herein refers to an immunoglobulin molecule or immunologically active portion thereof, i.e., an antigen-binding portion. Examples of immunologically active portions of immunoglobulin molecules include F(ab) and F(ab')$_2$ fragments which can be generated by treating the antibody with an enzyme such as pepsin. An antibody sometimes is a polyclonal, monoclonal, recombinant (e.g., a chimeric or humanized), fully human, non-human (e.g., murine), or a single chain antibody. An antibody may have effector function and can fix complement, and is sometimes coupled to a toxin or imaging agent.

A full-length polypeptide or antigenic peptide fragment encoded by a ICAM, MAPK10, KIAA0861, NUMA1 or GALE nucleotide sequence can be used as an immunogen or can be used to identify antibodies made with other immunogens, e.g., cells, membrane preparations, and the like. An antigenic peptide often includes at least 8 amino acid residues of the amino acid sequences encoded by a nucleotide sequence of SEQ ID NO: 1-12, or substantially identical sequence thereof, and encompasses an epitope. Antigenic peptides sometimes include 10 or more amino acids, 15 or more amino acids, 20 or more amino acids, or 30 or more amino acids. Hydrophilic and hydrophobic fragments of polypeptides sometimes are used as immunogens.

Epitopes encompassed by the antigenic peptide are regions located on the surface of the polypeptide (e.g., hydrophilic regions) as well as regions with high antigenicity. For example, an Emini surface probability analysis of the human polypeptide sequence can be used to indicate the regions that have a particularly high probability of being localized to the surface of the polypeptide and are thus likely to constitute surface residues useful for targeting antibody production. The antibody may bind an epitope on any domain or region on polypeptides described herein.

Also, chimeric, humanized, and completely human antibodies are useful for applications which include repeated administration to subjects. Chimeric and humanized monoclonal antibodies, comprising both human and non-human portions, can be made using standard recombinant DNA techniques. Such chimeric and humanized monoclonal antibodies can be produced by recombinant DNA techniques known in the art, for example using methods described in Robinson et al International Application No. PCT/US86/02269; Akira, et al European Patent Application 184,187; Taniguchi, M., European Patent Application 171,496; Morrison et al European Patent Application 173,494; Neuberger et al PCT International Publication No. WO 86/01533; Cabilly et al U.S. Pat. No. 4,816,567; Cabilly et al European Patent Application 125,023; Better et al., Science 240: 1041-1043 (1988); Liu et al., Proc. Natl. Acad. Sci. USA 84: 3439-3443 (1987); Liu et al., J. Immunol. 139: 3521-3526 (1987); Sun et al., Proc. Natl. Acad. Sci. USA 84: 214-218 (1987); Nishimura et al., Canc. Res. 47: 999-1005 (1987); Wood et al., Nature 314: 446-449 (1985); and Shaw et al., J. Natl. Cancer Inst. 80: 1553-1559 (1988); Morrison, S. L., Science 229: 1202-1207 (1985); Oi et al., BioTechniques 4: 214 (1986); Winter U.S. Pat. No. 5,225,539; Jones et al., Nature 321: 552-525 (1986); Verhoeyan et al., Science 239: 1534; and Beidler et al., J. Immunol. 141: 4053-4060 (1988).

Completely human antibodies are particularly desirable for therapeutic treatment of human patients. Such antibodies can be produced using transgenic mice that are incapable of expressing endogenous immunoglobulin heavy and light chains genes, but which can express human heavy and light chain genes. See, for example, Lonberg and Huszar, Int. Rev. Immunol. 13: 65-93 (1995); and U.S. Pat. Nos. 5,625,126; 5,633,425; 5,569,825; 5,661,016; and 5,545,806. In addition, companies such as Abgenix, Inc. (Fremont, Calif.) and Medarex, Inc. (Princeton, N.J.), can be engaged to provide human antibodies directed against a selected antigen using technology similar to that described above. Completely human antibodies that recognize a selected epitope also can be generated using a technique referred to as "guided selection." In this approach a selected non-human monoclonal antibody (e.g., a murine antibody) is used to guide the selection of a completely human antibody recognizing the same epitope. This technology is described for example by Jespers et al., Bio/Technology 12: 899-903 (1994).

Antibody can be a single chain antibody. A single chain antibody (scFV) can be engineered (see, e.g., Colcher et al., Ann. N Y Acad. Sci. 880: 263-80 (1999); and Reiter, Clin. Cancer Res. 2: 245-52 (1996)). Single chain antibodies can be dimerized or multimerized to generate multivalent antibodies having specificities for different epitopes of the same target polypeptide.

Antibodies also may be selected or modified so that they exhibit reduced or no ability to bind an Fc receptor. For example, an antibody may be an isotype or subtype, fragment or other mutant, which does not support binding to an Fc receptor (e.g., it has a mutagenized or deleted Fc receptor binding region).

Also, an antibody (or fragment thereof) may be conjugated to a therapeutic moiety such as a cytotoxin, a therapeutic agent or a radioactive metal ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1 dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, melphalan, carmustine (BCNU) and lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

Antibody conjugates can be used for modifying a given biological response. For example, the drug moiety may be a protein or polypeptide possessing a desired biological activity. Such proteins may include, for example, a toxin such as abrin, ricin A, pseudomonas exotoxin, or diphtheria toxin; a polypeptide such as tumor necrosis factor, γ-interferon, α-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors. Also, an antibody can be conjugated to a second antibody to form an antibody heteroconjugate as described by Segal in U.S. Pat. No. 4,676,980, for example.

An antibody (e.g., monoclonal antibody) can be used to isolate target polypeptides by standard techniques, such as affinity chromatography or immunoprecipitation. Moreover, an antibody can be used to detect a target polypeptide (e.g., in a cellular lysate or cell supernatant) in order to evaluate the abundance and pattern of expression of the polypeptide. Antibodies can be used diagnostically to monitor polypeptide levels in tissue as part of a clinical testing procedure, e.g., to determine the efficacy of a given treatment regimen. Detection can be facilitated by coupling (i.e., physically linking) the antibody to a detectable substance (i.e., antibody labeling). Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H. Also, an antibody can be utilized as a test molecule for determining whether it can treat breast cancer, and as a therapeutic for administration to a subject for treating breast cancer.

An antibody can be made by immunizing with a purified antigen, or a fragment thereof, e.g., a fragment described herein, a membrane associated antigen, tissues, e.g., crude tissue preparations, whole cells, preferably living cells, lysed cells, or cell fractions.

Included herein are antibodies which bind only a native polypeptide, only denatured or otherwise non-native polypeptide, or which bind both, as well as those having linear or conformational epitopes. Conformational epitopes sometimes can be identified by selecting antibodies that bind to native but not denatured polypeptide. Also featured are antibodies that specifically bind to a polypeptide variant associated with breast cancer.

Screening Assays

Featured herein are methods for identifying a candidate therapeutic for treating breast cancer. The methods comprise contacting a test molecule with a target molecule in a system. A "target molecule" as used herein refers to a nucleic acid of SEQ ID NO: 1-12, a substantially identical nucleic acid thereof, or a fragment thereof, and an encoded polypeptide of the foregoing. The method also comprises determining the presence or absence of an interaction between the test molecule and the target molecule, where the presence of an interaction between the test molecule and the nucleic acid or polypeptide identifies the test molecule as a candidate breast cancer therapeutic. The interaction between the test molecule and the target molecule may be quantified.

Test molecules and candidate therapeutics include, but are not limited to, compounds, antisense nucleic acids, siRNA molecules, ribozymes, polypeptides or proteins encoded by a ICAM, MAPK10, KIAA0861, NUMA1 or GALE nucleic acids, or a substantially identical sequence or fragment thereof, and immunotherapeutics (e.g., antibodies and HLA-presented polypeptide fragments). A test molecule or candidate therapeutic may act as a modulator of target molecule concentration or target molecule function in a system. A "modulator" may agonize (i.e., up-regulates) or antagonize (i.e., down-regulates) a target molecule concentration partially or completely in a system by affecting such cellular functions as DNA replication and/or DNA processing (e.g., DNA methylation or DNA repair), RNA transcription and/or RNA processing (e.g., removal of intronic sequences and/or translocation of spliced mRNA from the nucleus), polypeptide production (e.g., translation of the polypeptide from mRNA), and/or polypeptide post-translational modification (e.g., glycosylation, phosphorylation, and proteolysis of pro-polypeptides). A modulator may also agonize or antagonize a biological function of a target molecule partially or completely, where the function may include adopting a certain structural conformation, interacting with one or more binding partners, ligand binding, catalysis (e.g., phosphorylation, dephosphorylation, hydrolysis, methylation, and isomerization), and an effect upon a cellular event (e.g., effecting progression of breast cancer).

As used herein, the term "system" refers to a cell free in vitro environment and a cell-based environment such as a collection of cells, a tissue, an organ, or an organism. A system is "contacted" with a test molecule in a variety of manners, including adding molecules in solution and allowing them to interact with one another by diffusion, cell injection, and any administration routes in an animal. As used herein, the term "interaction" refers to an effect of a test molecule on test molecule, where the effect sometimes is binding between the test molecule and the target molecule, and sometimes is an observable change in cells, tissue, or organism.

There are many standard methods for detecting the presence or absence of an interaction between a test molecule and a target molecule. For example, titrametric, acidimetric, radiometric, NMR, monolayer, polarographic, spectrophotometric, fluorescent, and ESR assays probative of a target molecule interaction may be utilized.

In general, an interaction can be determined by labeling the test molecule and/or the ICAM, MAPK10, KIAA0861, NUMA1 or GALE molecule, where the label is covalently or non-covalently attached to the test molecule or ICAM, MAPK10, KIAA0861, NUMA1 or GALE molecule. The label is sometimes a radioactive molecule such as $^{125}$I, $^{131}$I, $^{35}$S, or $^{3}$H, which can be detected by direct counting of radioemission or by scintillation counting. Also, enzymatic labels such as horseradish peroxidase, alkaline phosphatase, or luciferase may be utilized where the enzymatic label can be detected by determining conversion of an appropriate substrate to product. Also, presence or absence of an interaction can be determined without labeling. For example, a microphysiometer (e.g., Cytosensor) is an analytical instrument that measures the rate at which a cell acidifies its environment using a light-addressable potentiometric sensor (LAPS). Changes in this acidification rate can be used as an indication of an interaction between a test molecule and ICAM, MAPK10, KIAA0861, NUMA1 or GALE (McConnell, H. M. et al., Science 257: 1906-1912 (1992)).

In cell-based systems, cells typically include a ICAM, MAPK10, KIAA0861, NUMA1 or GALE nucleic acid or polypeptide or variants thereof and are often of mammalian origin, although the cell can be of any origin. Whole cells, cell homogenates, and cell fractions (e.g., cell membrane fractions) can be subjected to analysis. Where interactions between a test molecule with a ICAM, MAPK10, KIAA0861, NUMA1 or GALE polypeptide or variant thereof are monitored, soluble and/or membrane bound forms of the polypeptide or variant may be utilized. Where membrane-bound forms of the polypeptide are used, it may be desirable to utilize a solubilizing agent. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)n, 3-[(3-cholamidopropyl)dimethylamminio]-1-propane sulfonate (CHAPS), 3-[(3-cholamidopropyl)dimethylamminio]-2-hydroxy-1-propane sulfonate (CHAPSO), or N-dodecyl-N,N-dimethyl-3-ammonio-1-propane sulfonate.

An interaction between two molecules also can be detected by monitoring fluorescence energy transfer (FET) (see, for example, Lakowicz et al., U.S. Pat. No. 5,631,169; Stavrianopoulos et al. U.S. Pat. No. 4,868,103). A fluorophore label on a first, "donor" molecule is selected such that its emitted fluorescent energy will be absorbed by a fluorescent label on a second, "acceptor" molecule, which in turn is able to fluoresce due to the absorbed energy. Alternately, the "donor" polypeptide molecule may simply utilize the natural fluorescent energy of tryptophan residues. Labels are chosen that emit different wavelengths of light, such that the "acceptor" molecule label may be differentiated from that of the "donor". Since the efficiency of energy transfer between the labels is related to the distance separating the molecules, the spatial relationship between the molecules can be assessed. In a situation in which binding occurs between the molecules, the fluorescent emission of the "acceptor" molecule label in the assay should be maximal. An FET binding event can be conveniently measured through standard fluorometric detection means well known in the art (e.g., using a fluorimeter).

In another embodiment, determining the presence or absence of an interaction between a test molecule and a ICAM, MAPK10, KIAA0861, NUMA1 or GALE molecule can be effected by using real-time Biomolecular Interaction Analysis (BIA) (see, e.g., Sjolander & Urbaniczk, Anal. Chem. 63: 2338-2345 (1991) and Szabo et al., Curr. Opin. Struct. Biol. 5: 699-705 (1995)). "Surface plasmon resonance" or "BIA" detects biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

In another embodiment, the ICAM, MAPK10, KIAA0861, NUMA1 or GALE molecule or test molecules are anchored to a solid phase. The ICAM, MAPK10, KIAA0861, NUMA1 or GALE molecule/test molecule complexes anchored to the solid phase can be detected at the end of the reaction. The target ICAM, MAPK10, KIAA0861, NUMA1 or GALE molecule is often anchored to a solid surface, and the test molecule, which is not anchored, can be labeled, either directly or indirectly, with detectable labels discussed herein.

It may be desirable to immobilize a ICAM, MAPK10, KIAA0861, NUMA1 or GALE molecule, an anti-ICAM, MAPK10, KIAA0861, NUMA1 or GALE antibody, or test molecules to facilitate separation of complexed from uncomplexed forms of ICAM, MAPK10, KIAA0861, NUMA1 or GALE molecules and test molecules, as well as to accommodate automation of the assay. Binding of a test molecule to a ICAM, MAPK10, KIAA0861, NUMA1 or GALE molecule can be accomplished in any vessel suitable for containing the reactants. Examples of such vessels include microtiter plates, test tubes, and micro-centrifuge tubes. In one embodiment, a fusion polypeptide can be provided which adds a domain that allows a ICAM, MAPK10, KIAA0861, NUMA1 or GALE molecule to be bound to a matrix. For example, glutathione-S-transferase/ICAM, MAPK10, KIAA0861, NUMA1 or GALE fusion polypeptides or glutathione-S-transferase/target fusion polypeptides can be adsorbed onto glutathione sepharose beads (Sigma Chemical, St. Louis, Mo.) or glutathione derivitized microtiter plates, which are then combined with the test compound or the test compound and either the non-adsorbed target polypeptide or ICAM, MAPK10, KIAA0861, NUMA1 or GALE polypeptide, and the mixture incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described above. Alternatively, the complexes can be dissociated from the matrix, and the level of ICAM, MAPK10, KIAA0861, NUMA1 or GALE binding or activity determined using standard techniques.

Other techniques for immobilizing a ICAM, MAPK10, KIAA0861, NUMA1 or GALE molecule on matrices include using biotin and streptavidin. For example, biotinylated ICAM, MAPK10, KIAA0861, NUMA1 or GALE polypeptide or target molecules can be prepared from biotin-NHS(N-hydroxy-succinimide) using techniques known in the art (e.g., biotinylation kit, Pierce Chemicals, Rockford, Ill.), and immobilized in the wells of streptavidin-coated 96 well plates (Pierce Chemical).

In order to conduct the assay, the non-immobilized component is added to the coated surface containing the anchored component. After the reaction is complete, unreacted components are removed (e.g., by washing) under conditions such that any complexes formed will remain immobilized on the solid surface. The detection of complexes anchored on the solid surface can be accomplished in a number of ways. Where the previously non-immobilized component is pre-labeled, the detection of label immobilized on the surface indicates that complexes were formed. Where the previously non-immobilized component is not pre-labeled, an indirect label can be used to detect complexes anchored on the surface; e.g., using a labeled antibody specific for the immobilized component (the antibody, in turn, can be directly labeled or indirectly labeled with, e.g., a labeled anti-Ig antibody).

In one embodiment, this assay is performed utilizing antibodies reactive with ICAM, MAPK10, KIAA0861, NUMA1 or GALE polypeptide or test molecules but which do not interfere with binding of the ICAM, MAPK10, KIAA0861, NUMA1 or GALE polypeptide to its test molecule. Such antibodies can be derivitized to the wells of the plate, and unbound target or ICAM, MAPK10, KIAA0861, NUMA1 or GALE polypeptide trapped in the wells by antibody conjugation. Methods for detecting such complexes, in addition to those described above for the GST-immobilized complexes, include immunodetection of complexes using antibodies reactive with the ICAM, MAPK10, KIAA0861, NUMA1 or GALE polypeptide or target molecule, as well as enzyme-linked assays which rely on detecting an enzymatic activity associated with the ICAM, MAPK10, KIAA0861, NUMA1 or GALE polypeptide or test molecule.

Alternatively, cell free assays can be conducted in a liquid phase. In such an assay, the reaction products are separated from unreacted components, by any of a number of standard techniques, including but not limited to: differential centrifugation (see, for example, Rivas, G., and Minton, A. P., Trends Biochem Sci August; 18(8): 284-7 (1993)); chromatography (gel filtration chromatography, ion-exchange chromatography); electrophoresis (see, e.g., Ausubel et al., eds. Current Protocols in Molecular Biology, J. Wiley: New York (1999)); and immunoprecipitation (see, for example, Ausubel, F. et al., eds. Current Protocols in Molecular Biology, J. Wiley: New York (1999)). Such resins and chromatographic techniques are known to one skilled in the art (see, e.g., Heegaard, J. Mol. Recognit. Winter; 11(1-6): 141-8 (1998); Hage & Tweed, J. Chromatogr. B Biomed. Sci. Appl. October 10; 699 (1-2): 499-525 (1997)). Further, fluorescence energy transfer may also be conveniently utilized, as described herein, to detect binding without further purification of the complex from solution.

In another embodiment, modulators of ICAM, MAPK10, KIAA0861, NUMA1 or GALE expression are identified. For example, a cell or cell free mixture is contacted with a candidate compound and the expression of ICAM, MAPK10, KIAA0861, NUMA1 or GALE mRNA or polypeptide evaluated relative to the level of expression of ICAM, MAPK10, KIAA0861, NUMA1 or GALE mRNA or polypeptide in the absence of the candidate compound. When expression of ICAM, MAPK10, KIAA0861, NUMA1 or GALE mRNA or polypeptide is greater in the presence of the candidate compound than in its absence, the candidate compound is identified as a stimulator of ICAM, MAPK10, KIAA0861, NUMA1 or GALE mRNA or polypeptide expression. Alternatively, when expression of ICAM, MAPK10, KIAA0861, NUMA1 or GALE mRNA or polypeptide is less (statistically significantly less) in the presence of the candidate compound than in its absence, the candidate compound is identified as an inhibitor of ICAM, MAPK10, KIAA0861, NUMA1 or GALE mRNA or polypeptide expression. The level of ICAM, MAPK10, KIAA0861, NUMA1 or GALE mRNA or polypeptide expression can be determined by methods described herein for detecting ICAM, MAPK10, KIAA0861, NUMA1 or GALE mRNA or polypeptide.

In another embodiment, binding partners that interact with a ICAM, MAPK10, KIAA0861, NUMA1 or GALE molecule are detected. The ICAM, MAPK10, KIAA0861, NUMA1 or GALE molecules can interact with one or more cellular or extracellular macromolecules, such as polypeptides, in vivo, and these molecules that interact with ICAM, MAPK10, KIAA0861, NUMA1 or GALE molecules are referred to herein as "binding partners." Molecules that disrupt such interactions can be useful in regulating the activity of the target gene product. Such molecules can include, but are not limited to molecules such as antibodies, peptides, and small molecules. Target genes/products for use in this embodiment often are the ICAM, MAPK10, KIAA0861, NUMA1 or GALE genes herein identified. In an alternative embodiment, provided is a method for determining the ability of the test compound to modulate the activity of a ICAM, MAPK10, KIAA0861, NUMA1 or GALE polypeptide through modulation of the activity of a downstream effector of a ICAM, MAPK10, KIAA0861, NUMA1 or GALE target molecule. For example, the activity of the effector molecule on an appropriate target can be determined, or the binding of the effector to an appropriate target can be determined, as previously described.

To identify compounds that interfere with the interaction between the target gene product and its cellular or extracellular binding partner(s), e.g., a substrate, a reaction mixture containing the target gene product and the binding partner is prepared, under conditions and for a time sufficient, to allow the two products to form complex. In order to test an inhibitory agent, the reaction mixture is provided in the presence and absence of the test compound. The test compound can be initially included in the reaction mixture, or can be added at a time subsequent to the addition of the target gene and its cellular or extracellular binding partner. Control reaction mixtures are incubated without the test compound or with a placebo. The formation of any complexes between the target gene product and the cellular or extracellular binding partner is then detected. The formation of a complex in the control reaction, but not in the reaction mixture containing the test compound, indicates that the compound interferes with the interaction of the target gene product and the interactive binding partner. Additionally, complex formation within reaction mixtures containing the test compound and normal target gene product can also be compared to complex formation within reaction mixtures containing the test compound and mutant target gene product. This comparison can be important in those cases where it is desirable to identify compounds that disrupt interactions of mutant but not normal target gene products.

These assays can be conducted in a heterogeneous or homogeneous format. Heterogeneous assays involve anchoring either the target gene product or the binding partner onto a solid phase, and detecting complexes anchored on the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction between the target gene products and the binding partners, e.g., by competition, can be identified by conducting the reaction in the presence of the test substance. Alternatively, test compounds that disrupt preformed complexes, e.g., compounds with higher binding constants that displace one of the components from the complex, can be tested by adding the test compound to the reaction mixture after complexes have been formed. The various formats are briefly described below.

In a heterogeneous assay system, either the target gene product or the interactive cellular or extracellular binding partner, is anchored onto a solid surface (e.g., a microtiter plate), while the non-anchored species is labeled, either directly or indirectly. The anchored species can be immobilized by non-covalent or covalent attachments. Alternatively, an immobilized antibody specific for the species to be anchored can be used to anchor the species to the solid surface.

In order to conduct the assay, the partner of the immobilized species is exposed to the coated surface with or without the test compound. After the reaction is complete, unreacted components are removed (e.g., by washing) and any complexes formed will remain immobilized on the solid surface. Where the non-immobilized species is pre-labeled, the detection of label immobilized on the surface indicates that complexes were formed. Where the non-immobilized species is not pre-labeled, an indirect label can be used to detect complexes anchored on the surface; e.g., using a labeled antibody specific for the initially non-immobilized species (the antibody, in turn, can be directly labeled or indirectly labeled with, e.g., a labeled anti-Ig antibody). Depending upon the order of addition of reaction components, test compounds that inhibit complex formation or that disrupt preformed complexes can be detected.

Alternatively, the reaction can be conducted in a liquid phase in the presence or absence of the test compound, the reaction products separated from unreacted components, and complexes detected; e.g., using an immobilized antibody specific for one of the binding components to anchor any complexes formed in solution, and a labeled antibody specific for the other partner to detect anchored complexes. Again, depending upon the order of addition of reactants to the liquid phase, test compounds that inhibit complex or that disrupt preformed complexes can be identified.

In an alternate embodiment, a homogeneous assay can be used. For example, a preformed complex of the target gene product and the interactive cellular or extracellular binding partner product is prepared in that either the target gene products or their binding partners are labeled, but the signal generated by the label is quenched due to complex formation (see, e.g., U.S. Pat. No. 4,109,496 that utilizes this approach for immunoassays). The addition of a test substance that competes with and displaces one of the species from the preformed complex will result in the generation of a signal above background. In this way, test substances that disrupt target gene product-binding partner interaction can be identified.

Also, binding partners of ICAM, MAPK10, KIAA0861, NUMA1 or GALE molecules can be identified in a two-hybrid assay or three-hybrid assay (see, e.g., U.S. Pat. No. 5,283,317; Zervos et al., Cell 72:223-232 (1993); Madura et al., J. Biol. Chem. 268: 12046-12054 (1993); Bartel et al., Biotechniques 14: 920-924 (1993); Iwabuchi et al., Oncogene 8: 1693-1696 (1993); and Brent WO94/10300), to identify other polypeptides, which bind to or interact with ICAM, MAPK10, KIAA0861, NUMA1 or GALE ("ICAM, MAPK10, KIAA0861, NUMA1 or GALE-binding polypeptides" or "ICAM, MAPK10, KIAA0861, NUMA1 or GALE-bp") and are involved in ICAM, MAPK10, KIAA0861, NUMA1 or GALE activity. Such ICAM, MAPK10, KIAA0861, NUMA1 or GALE-bps can be activators or inhibitors of signals by the ICAM, MAPK10, KIAA0861, NUMA1 or GALE polypeptides or ICAM, MAPK10, KIAA0861, NUMA1 or GALE targets as, for example, downstream elements of a ICAM, MAPK10, KIAA0861, NUMA1 or GALE-mediated signaling pathway.

A two-hybrid system is based on the modular nature of most transcription factors, which consist of separable DNA-binding and activation domains. Briefly, the assay utilizes two different DNA constructs. In one construct, the gene that codes for a ICAM, MAPK10, KIAA0861, NUMA1 or GALE polypeptide is fused to a gene encoding the DNA binding domain of a known transcription factor (e.g., GAL-4). In the other construct, a DNA sequence, from a library of DNA sequences, that encodes an unidentified polypeptide ("prey" or "sample") is fused to a gene that codes for the activation domain of the known transcription factor. (Alternatively the: ICAM, MAPK10, KIAA0861, NUMA1 or GALE polypeptide can be the fused to the activator domain.) If the "bait" and the "prey" polypeptides are able to interact, in vivo, forming a ICAM, MAPK10, KIAA0861, NUMA1 or GALE-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the polypeptide which interacts with the ICAM, MAPK10, KIAA0861, NUMA1 or GALE polypeptide.

Candidate therapeutics for treating breast cancer are identified from a group of test molecules that interact with a ICAM, MAPK10, KIAA0861, NUMA1 or GALE nucleic acid or polypeptide. Test molecules are normally ranked according to the degree with which they interact or modulate (e.g., agonize or antagonize) DNA replication and/or processing, RNA transcription and/or processing, polypeptide production and/or processing, and/or function of ICAM, MAPK10, KIAA0861, NUMA1 or GALE molecules, for example, and then top ranking modulators are selected. In a preferred embodiment, the candidate therapeutic (i.e., test molecule) acts as a ICAM, MAPK10, KIAA0861, NUMA1 or GALE antagonist. Also, pharmacogenomic information described herein can determine the rank of a modulator. Candidate therapeutics typically are formulated for administration to a subject.

Therapeutic Treatments

Formulations or pharmaceutical compositions typically include in combination with a pharmaceutically acceptable carrier, a compound, an antisense nucleic acid, a ribozyme, an antibody, a binding partner that interacts with a ICAM, MAPK10, KIAA0861, NUMA1 or GALE polypeptide, a ICAM, MAPK10, KIAA0861, NUMA1 or GALE nucleic acid, or a fragment thereof. The formulated molecule may be one that is identified by a screening method described above. As used herein, the term "pharmaceutically acceptable carrier" includes solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerin, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, isotonic agents, for example, sugars, polyalcohols such as mannitol, sorbitol, sodium chloride sometimes are included in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, methods of preparation often utilized are vacuum drying and freeze-drying which yields a powder of the active ingredient plus any additional desired ingredient from a previously sterile-filtered solution thereof.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art. Molecules can also be prepared in the form of suppositories (e.g., with conventional suppository bases such as cocoa butter and other glycerides) or retention enemas for rectal delivery.

In one embodiment, active molecules are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Molecules which exhibit high therapeutic indices often are utilized. While molecules that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such molecules often lies within a range of circulating concentrations that include the $ED_{50}$ with little or no toxicity. The dosage may vary within this range depending upon the dosage form employed and the route of administration utilized. For any molecules used in the methods described herein, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of protein or polypeptide (i.e., an effective dosage) ranges from about 0.001 to 30 mg/kg body weight, sometimes about 0.01 to 25 mg/kg body weight, often about 0.1 to 20 mg/kg body weight, and more often about 1 to 10 mg/kg, 2 to 9 mg/kg, 3 to 8 mg/kg, 4 to 7 mg/kg, or 5 to 6 mg/kg body weight. The protein or polypeptide can be administered one time per week for between about 1 to 10 weeks, sometimes between 2 to 8 weeks, often between about 3 to 7 weeks, and more often for about 4, 5, or 6 weeks. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment, or sometimes can include a series of treatments.

With regard to polypeptide formulations, featured herein is a method for treating breast cancer in a subject, which comprises contacting one or more cells in the subject with a first ICAM, MAPK10, KIAA0861, NUMA1 or GALE polypeptide, where the subject comprises a second ICAM, MAPK10, KIAA0861, NUMA1 or GALE polypeptide having one or more polymorphic variations associated with cancer, and where the first polypeptide comprises fewer polymorphic variations associated with cancer than the second polypeptide. The first and second polypeptides are encoded by a nucleic acid which comprises a nucleotide sequence selected from the group consisting of the nucleotide sequence of SEQ ID NO: 1-12; a nucleotide sequence which encodes a polypeptide consisting of an amino acid sequence encoded by a nucleotide sequence of SEQ ID NO: 1-12; a nucleotide sequence which encodes a polypeptide that is 90% or more identical to an amino acid sequence encoded by a nucleotide sequence of SEQ ID NO: 1-12 and a nucleotide sequence 90% or more identical to a nucleotide sequence of SEQ ID NO: 1-12. The subject is often a human.

For antibodies, a dosage of 0.1 mg/kg of body weight (generally 10 mg/kg to 20 mg/kg) is often utilized. If the antibody is to act in the brain, a dosage of 50 mg/kg to 100 mg/kg is often appropriate. Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the brain). A method for lipidation of antibodies is described by Cruikshank et al., J. Acquired Immune Deficiency Syndromes and Human Retrovirology 14:193 (1997).

Antibody conjugates can be used for modifying a given biological response, the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a polypeptide such as tumor necrosis factor, .alpha.-interferon, .beta.-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors. Alternatively, an antibody can be conjugated to a second antibody to form an antibody heteroconjugate as described by Segal in U.S. Pat. No. 4,676,980.

For compounds, exemplary doses include milligram or microgram amounts of the compound per kilogram of subject or sample weight, for example, about 1 microgram per kilogram to about 500 milligrams per kilogram, about 100 micrograms per kilogram to about 5 milligrams per kilogram, or about 1 microgram per kilogram to about 50 micrograms per kilogram. It is understood that appropriate doses of a small molecule depend upon the potency of the small molecule with respect to the expression or activity to be modulated. When one or more of these small molecules is to be administered to an animal (e.g., a human) in order to modulate expression or activity of a polypeptide or nucleic acid described herein, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

ICAM, MAPK10, KIAA0861, NUMA1 or GALE nucleic acid molecules can be inserted into vectors and used in gene therapy methods for treating breast cancer. Featured herein is a method for treating breast cancer in a subject, which comprises contacting one or more cells in the subject with a first ICAM, MAPK10, KIAA0861, NUMA1 or GALE nucleic acid, where genomic DNA in the subject comprises a second ICAM, MAPK10, KIAA0861, NUMA1 or GALE nucleic acid comprising one or more polymorphic variations associated with breast cancer, and where the first nucleic acid comprises fewer polymorphic variations associated with breast cancer. The first and second nucleic acids typically comprise a nucleotide sequence selected from the group consisting of the nucleotide sequence of SEQ ID NO: 1-5; a nucleotide sequence which encodes a polypeptide consisting of an amino acid sequence encoded by a nucleotide sequence in SEQ ID NO: 1-5; a nucleotide sequence that is 90% or more identical to the nucleotide sequence of SEQ ID NO: 1-5, and a nucleotide sequence which encodes a polypeptide that is 90% or more identical to an amino acid sequence encoded by a nucleotide sequence in SEQ ID NO: 1-5. The subject often is a human.

Gene therapy vectors can be delivered to a subject by, for example, intravenous injection, local administration (see U.S. Pat. No. 5,328,470) or by stereotactic injection (see e.g., Chen et al., (1994) Proc. Natl. Acad. Sci. USA 91:3054-3057). Pharmaceutical preparations of gene therapy vectors can include a gene therapy vector in an acceptable diluent, or can comprise a slow release matrix in which the gene delivery vehicle is imbedded. Alternatively, where the complete gene delivery vector can be produced intact from recombinant cells (e.g., retroviral vectors) the pharmaceutical preparation can include one or more cells which produce the gene delivery system. Examples of gene delivery vectors are described herein.

Pharmaceutical compositions can be included in a container, pack, or dispenser together with instructions for administration.

Pharmaceutical compositions of active ingredients can be administered by any of the paths described herein for therapeutic and prophylactic methods for treating breast cancer. With regard to both prophylactic and therapeutic methods of treatment, such treatments may be specifically tailored or modified, based on knowledge obtained from pharmacogenomic analyses described herein. As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease. A therapeutic agent includes, but is not limited to, small molecules, peptides, antibodies, ribozymes and antisense oligonucleotides.

Administration of a prophylactic agent can occur prior to the manifestation of symptoms characteristic of the ICAM, MAPK10, KIAA0861, NUMA1 or GALE aberrance, such that a disease or disorder is prevented or, alternatively, delayed in its progression. Depending on the type of ICAM, MAPK10, KIAA0861, NUMA1 or GALE aberrance, for example, a ICAM, MAPK10, KIAA0861, NUMA1 or GALE molecule, ICAM, MAPK10, KIAA0861, NUMA1 or GALE agonist, or ICAM, MAPK10, KIAA0861, NUMA1 or GALE antagonist agent can be used for treating the subject. The appropriate agent can be determined based on screening assays described herein.

As discussed, successful treatment of ICAM, MAPK10, KIAA0861, NUMA1 or GALE disorders can be brought about by techniques that serve to inhibit the expression or activity of target gene products. For example, compounds (e.g., an agent identified using an assays described above) that exhibit negative modulatory activity can be used to prevent and/or treat breast cancer. Such molecules can include, but are not limited to peptides, phosphopeptides, small organic or inorganic molecules, or antibodies (including, for example, polyclonal, monoclonal, humanized, anti-idiotypic, chimeric or single chain antibodies, and FAb, F(ab')2 and FAb expression library fragments, scFV molecules, and epitope-binding fragments thereof).

Further, antisense and ribozyme molecules that inhibit expression of the target gene can also be used to reduce the level of target gene expression, thus effectively reducing the level of target gene activity. Still further, triple helix molecules can be utilized in reducing the level of target gene activity. Antisense, ribozyme and triple helix molecules are discussed above.

It is possible that the use of antisense, ribozyme, and/or triple helix molecules to reduce or inhibit mutant gene expression can also reduce or inhibit the transcription (triple helix) and/or translation (antisense, ribozyme) of mRNA produced by normal target gene alleles, such that the concentration of normal target gene product present can be lower than is necessary for a normal phenotype. In such cases, nucleic acid molecules that encode and express target gene polypeptides exhibiting normal target gene activity can be introduced into cells via gene therapy method. Alternatively, in instances where the target gene encodes an extracellular polypeptide, normal target gene polypeptide often is co-administered into the cell or tissue to maintain the requisite level of cellular or tissue target gene activity.

Another method by which nucleic acid molecules may be utilized in treating or preventing a disease characterized by ICAM, MAPK10, KIAA0861, NUMA1 or GALE expression is through the use of aptamer molecules specific for ICAM, MAPK10, KIAA0861, NUMA1 or GALE polypeptide. Aptamers are nucleic acid molecules having a tertiary structure which permits them to specifically bind to polypeptide ligands (see, e.g., Osborne, et al., Curr. Opin. Chem. Biol. 1(1): 5-9 (1997); and Patel, D. J., Curr. Opin. Chem. Biol. June; 1(1): 3246 (1997)). Since nucleic acid molecules may in many cases be more conveniently introduced into target cells than therapeutic polypeptide molecules may be, aptamers offer a method by which ICAM, MAPK10, KIAA0861, NUMA1 or GALE polypeptide activity may be specifically decreased without the introduction of drugs or other molecules which may have pluripotent effects.

Antibodies can be generated that are both specific for target gene product and that reduce target gene product activity. Such antibodies may, therefore, by administered in instances whereby negative modulatory techniques are appropriate for the treatment of ICAM, MAPK10, KIAA0861, NUMA1 or GALE disorders. For a description of antibodies, see the Antibody section above.

In circumstances where injection of an animal or a human subject with a ICAM, MAPK10, KIAA0861, NUMA1 or GALE polypeptide or epitope for stimulating antibody production is harmful to the subject, it is possible to generate an immune response against ICAM, MAPK10, KIAA0861, NUMA1 or GALE through the use of anti-idiotypic antibodies (see, for example, Herlyn, D., Ann. Med.; 31(1): 66-78 (1999); and Bhattacharya-Chatterjee & Foon, Cancer Treat. Res.; 94: 51-68 (1998)). If an anti-idiotypic antibody is introduced into a mammal or human subject, it should stimulate the production of anti-anti-idiotypic antibodies, which should be specific to the ICAM, MAPK10, KIAA0861, NUMA1 or GALE polypeptide. Vaccines directed to a disease characterized by ICAM, MAPK10, KIAA0861, NUMA1 or GALE expression may also be generated in this fashion.

In instances where the target antigen is intracellular and whole antibodies are used, internalizing antibodies may be utilized. Lipofectin or liposomes can be used to deliver the antibody or a fragment of the Fab region that binds to the target antigen into cells. Where fragments of the antibody are used, the smallest inhibitory fragment that binds to the target antigen often is utilized. For example, peptides having an amino acid sequence corresponding to the Fv region of the antibody can be used. Alternatively, single chain neutralizing antibodies that bind to intracellular target antigens can also be administered. Such single chain antibodies can be administered, for example, by expressing nucleotide sequences encoding single-chain antibodies within the target cell population (see e.g., Marasco et al., Proc. Natl. Acad. Sci. USA 90: 7889-7893 (1993)).

ICAM, MAPK10, KIAA0861, NUMA1 or GALE molecules and compounds that inhibit target gene expression, synthesis and/or activity can be administered to a patient at therapeutically effective doses to prevent, treat or ameliorate ICAM, MAPK10, KIAA0861, NUMA1 or GALE disorders. A therapeutically effective dose refers to that amount of the compound sufficient to result in amelioration of symptoms of the disorders.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit large therapeutic indices often are utilized. While compounds that exhibit toxic side effects can be used, care should be taken to design a delivery system that targets such compounds to the site of affected tissue in order to minimize potential damage to uninfected cells and, thereby, reduce side effects.

Data obtained from cell culture assays and animal studies can be used in formulating a range of dosage for use in humans. The dosage of such compounds often lies within a range of circulating concentrations that include the $ED_{50}$ with little or no toxicity. The dosage can vary within this range depending upon the dosage form employed and the route of administration utilized. For any compound used in a method described herein, the therapeutically effective dose can be estimated initially from cell culture assays. A dose can be formulated in animal models to achieve a circulating plasma concentration range that includes the $IC_{50}$ (i.e., the concentration of the test compound that achieves a half-maximal inhibition of symptoms) as determined in cell culture. Such information can be used to more accurately determine useful doses in humans. Levels in plasma can be measured, for example, by high performance liquid chromatography.

Another example of effective dose determination for an individual is the ability to directly assay levels of "free" and "bound" compound in the serum of the test subject. Such assays may utilize antibody mimics and/or "biosensors" that have been created through molecular imprinting techniques. The compound which is able to modulate ICAM, MAPK10, KIAA0861, NUMA1 or GALE activity is used as a template, or "imprinting molecule", to spatially organize polymerizable monomers prior to their polymerization with catalytic reagents. The subsequent removal of the imprinted molecule leaves a polymer matrix which contains a repeated "negative image" of the compound and is able to selectively rebind the molecule under biological assay conditions. A detailed review of this technique can be seen in Ansell et al., Current Opinion in Biotechnology 7: 89-94 (1996) and in Shea, Trends in Polymer Science 2: 166-173 (1994). Such "imprinted" affinity matrixes are amenable to ligand-binding assays, whereby the immobilized monoclonal antibody component is replaced by an appropriately imprinted matrix. An example of the use of such matrixes in this way can be seen in Vlatakis, et al., Nature 361: 645-647 (1993). Through the use of isotope-labeling, the "free" concentration of compound which modulates the expression or activity of ICAM, MAPK10, KIAA0861, NUMA1 or GALE can be readily monitored and used in calculations of $IC_{50}$. Such "imprinted" affinity matrixes can also be designed to include fluorescent groups whose photon-emitting properties measurably change upon local and selective binding of target compound. These changes can be readily assayed in real time using appropriate fiberoptic devices, in turn allowing the dose in a test subject to be quickly optimized based on its individual $IC_{50}$. A rudimentary example of such a "biosensor" is discussed in Kriz et al., Analytical Chemistry 67: 2142-2144 (1995).

Provided herein are methods of modulating ICAM, MAPK10, KIAA0861, NUMA1 or GALE expression or activity for therapeutic purposes. Accordingly, in an exemplary embodiment, the modulatory method involves contacting a cell with a ICAM, MAPK10, KIAA0861, NUMA1 or GALE or agent that modulates one or more of the activities of ICAM, MAPK10, KIAA0861, NUMA1 or GALE polypeptide activity associated with the cell. An agent that modulates ICAM, MAPK10, KIAA0861, NUMA1 or GALE polypeptide activity can be an agent as described herein, such as a nucleic acid or a polypeptide, a naturally-occurring target molecule of a ICAM, MAPK10, KIAA0861, NUMA1 or GALE polypeptide (e.g., a ICAM, MAPK10, KIAA0861, NUMA1 or GALE substrate or receptor), a ICAM, MAPK10, KIAA0861, NUMA1 or GALE antibody, a ICAM, MAPK10, KIAA0861, NUMA1 or GALE agonist or antagonist, a peptidomimetic of a ICAM, MAPK10, KIAA0861, NUMA1 or GALE agonist or antagonist, or other small molecule.

In one embodiment, the agent stimulates one or more ICAM, MAPK10, KIAA0861, NUMA1 or GALE activities. Examples of such stimulatory agents include active ICAM, MAPK10, KIAA0861, NUMA1 or GALE polypeptide and a nucleic acid molecule encoding ICAM, MAPK10, KIAA0861, NUMA1 or GALE. In another embodiment, the agent inhibits one or more ICAM, MAPK10, KIAA0861, NUMA1 or GALE activities. Examples of such inhibitory agents include antisense ICAM, MAPK10, KIAA0861, NUMA1 or GALE nucleic acid molecules, anti-ICAM, MAPK10, KIAA0861, NUMA1 or GALE antibodies, and ICAM, MAPK10, KIAA0861, NUMA1 or GALE inhibitors, and competitive inhibitors that target ICAM, MAPK10, KIAA0861, NUMA1 or GALE. These modulatory methods can be performed in vitro (e.g., by culturing the cell with the agent) or, alternatively, in vivo (e.g., by administering the agent to a subject). As such, provided are methods of treating an individual afflicted with a disease or disorder characterized by aberrant or unwanted expression or activity of a ICAM, MAPK10, KIAA0861, NUMA1 or GALE polypeptide or nucleic acid molecule. In one embodiment, the method involves administering an agent (e.g., an agent identified by a screening assay described herein), or combination of agents that modulates (e.g., upregulates or downregulates) ICAM, MAPK10, KIAA0861, NUMA1 or GALE expression or activity. In another embodiment, the method involves administering a ICAM, MAPK10, KIAA0861, NUMA1 or GALE polypeptide or nucleic acid molecule as therapy to compensate for reduced, aberrant, or unwanted ICAM, MAPK10, KIAA0861, NUMA1 or GALE expression or activity.

Stimulation of ICAM, MAPK10, KIAA0861, NUMA1 or GALE activity is desirable in situations in which ICAM, MAPK10, KIAA0861, NUMA1 or GALE is abnormally downregulated and/or in which increased ICAM, MAPK10, KIAA0861, NUMA1 or GALE activity is likely to have a beneficial effect. For example, stimulation of ICAM, MAPK10, KIAA0861, NUMA1 or GALE activity is desirable in situations in which a ICAM, MAPK10, KIAA0861, NUMA1 or GALE is downregulated and/or in which increased ICAM, MAPK10, KIAA0861, NUMA1 or GALE activity is likely to have a beneficial effect. Likewise, inhibition of ICAM, MAPK10, KIAA0861, NUMA1 or GALE activity is desirable in situations in which ICAM, MAPK10, KIAA0861, NUMA1 or GALE is abnormally upregulated and/or in which decreased ICAM, MAPK10, KIAA0861, NUMA1 or GALE activity is likely to have a beneficial effect.

Methods of Treatment

In another aspect, provided are methods for identifying a risk of cancer in an individual as described herein and, if a genetic predisposition is identified, treating that individual to delay or reduce or prevent the development of cancer. Such a procedure can be used to treat breast cancer. Optionally, treating an individual for cancer may include inhibiting cellular proliferation, inhibiting metastasis, inhibiting invasion, or preventing tumor formation or growth as defined herein. Suitable treatments to prevent or reduce or delay breast cancer focus on inhibiting additional cellular proliferation, inhibiting metastasis, inhibiting invasion, and preventing further tumor formation or growth. Treatment usually includes surgery followed by radiation therapy. Surgery may be a lumpectomy or a mastectomy (e.g., total, simple or radical). Even if the doctor removes all of the cancer that can be seen at the time of surgery, the patient may be given radiation therapy, chemotherapy, or hormone therapy after surgery to try to kill any cancer cells that may be left. Radiation therapy is the use of x-rays or other types of radiation to kill cancer cells and shrink tumors. Radiation therapy may use external radiation (using a machine outside the body) or internal radiation. Chemotherapy is the use of drugs to kill cancer cells. Chemotherapy may be taken by mouth, or it may be put into the body by inserting a needle into a vein or muscle. Hormone therapy often focuses on estrogen and progesterone, which are hormones that affect the way some cancers grow. If tests show that the cancer cells have estrogen and progesterone receptors (molecules found in some cancer cells to which estrogen and progesterone will attach), hormone therapy is used to block the way these hormones help the cancer grow. Hormone therapy with tamoxifen is often given to patients with early stages of breast cancer and those with metastatic breast cancer. Other types of treatment being tested in clinical trials include sentinel lymph node biopsy followed by surgery and high-dose chemotherapy with bone marrow transplantation and peripheral blood stem cell transplantation. Any preventative/therapeutic treatment known in the art may be prescribed and/or administered, including, for example, surgery, chemotherapy and/or radiation treatment, and any of the treatments may be used in combination with one another to treat or prevent breast cancer (e.g., surgery followed by radiation therapy).

Also provided are methods of preventing or treating cancer comprising providing an individual in need of such treatment with a ICAM, MAPK10, KIAA0861, NUMA1 or GALE inhibitor that reduces or inhibits the overexpression of mutant ICAM, MAPK10, KIAA0861, NUMA1 or GALE (e.g., a ICAM, MAPK10, KIAA0861, NUMA1 or GALE polynucleotide with an allele that is associated with cancer). Included herein are methods of reducing or blocking the expression of ICAM, MAPK10, KIAA0861, NUMA1 or GALE comprising providing or administering to individuals in need of reducing or blocking the expression of ICAM, MAPK10, KIAA0861, NUMA1 or GALE a pharmaceutical or physiologically acceptable composition comprising a molecule capable of inhibiting expression of ICAM, MAPK10, KIAA0861, NUMA1 or GALE, e.g., a siRNA molecule. Also included herein are methods of reducing or blocking the expression of secondary regulatory genes regulated by ICAM, MAPK10, KIAA0861, NUMA1 or GALE that play a role in oncogenesis which comprises introducing competitive inhibitors that target ICAM, MAPK10, KIAA0861, NUMA1 or GALE's effect on these regulatory genes or that block the binding of positive factors necessary for the expression of these regulatory genes.

The examples set forth below are intended to illustrate but not limit the invention.

EXAMPLES

In the following studies a group of subjects were selected according to specific parameters relating to breast cancer. Nucleic acid samples obtained from individuals in the study group were subjected to genetic analysis, which identified associations between breast cancer and certain polymorphic variants in ICAM region, MAPK10, KIAA0861, NUMA1/FLJ20625/LOC220074 region, and HT014/LOC148902/LYPLA2/GALE region loci (herein referred to as "target genes", "target nucleotides", "target polypeptides" or simply "targets"). In addition, methods are described for combining information from multiple SNPs from the target genes found to be independently associated with breast cancer status in a case-control study. The resulting model permits a powerful, more informative quantitation of the combined value of the SNPs for predicting breast cancer susceptibility.

Example 1

Samples and Pooling Strategies

Sample Selection

Blood samples were collected from individuals diagnosed with breast cancer, which were referred to as case samples. Also, blood samples were collected from individuals not diagnosed with breast cancer as gender and age-matched controls. All of the samples were of German/German descent. A database was created that listed all phenotypic trait information gathered from individuals for each case and control sample. Genomic DNA was extracted from each of the blood samples for genetic analyses.

DNA Extraction from Blood Samples

Six to ten milliliters of whole blood was transferred to a 50 ml tube containing 27 ml of red cell lysis solution (RCL). The tube was inverted until the contents were mixed. Each tube was incubated for 10 minutes at room temperature and inverted once during the incubation. The tubes were then centrifuged for 20 minutes at 3000×g and the supernatant was carefully poured off. 100-200 µl of residual liquid was left in the tube and was pipetted repeatedly to resuspend the pellet in the residual supernatant. White cell lysis solution (WCL) was added to the tube and pipetted repeatedly until completely mixed. While no incubation was normally required, the solution was incubated at 37° C. or room temperature if cell clumps were visible after mixing until the solution was homogeneous. 2 ml of protein precipitation was added to the cell lysate. The mixtures were vortexed vigorously at high speed for 20 sec to mix the protein precipitation solution uniformly with the cell lysate, and then centrifuged for 10 minutes at 3000×g. The supernatant containing the DNA was then poured into a clean 15 ml tube, which contained 7 ml of 100% isopropanol. The samples were mixed by inverting the tubes gently until white threads of DNA were visible. Samples were centrifuged for 3 minutes at 2000×g and the DNA was visible as a small white pellet. The supernatant was decanted and 5 ml of 70% ethanol was added to each tube. Each tube was inverted several times to wash the DNA pellet, and then centrifuged for 1 minute at 2000×g. The ethanol was decanted and each tube was drained on clean absorbent paper. The DNA was dried in the tube by inversion for 10 minutes, and then 1000 µl of 1×TE was added. The size of each sample was estimated, and less TE buffer was added during the following DNA hydration step if the sample was smaller. The DNA was allowed to rehydrate overnight at room temperature, and DNA samples were stored at 2-8° C.

DNA was quantified by placing samples on a hematology mixer for at least 1 hour. DNA was serially diluted (typically 1:80, 1:160, 1:320, and 1:640 dilutions) so that it would be within the measurable range of standards. 125 µl of diluted DNA was transferred to a clear U-bottom microtitre plate, and 125 µl of 1×TE buffer was transferred into each well using a multichannel pipette. The DNA and 1×TE were mixed by repeated pipetting at least 15 times, and then the plates were sealed. 50 µl of diluted DNA was added to wells A5-H12 of a black flat bottom microtitre plate. Standards were inverted six times to mix them, and then 50 µl of 1×TE buffer was pipetted into well A1, 1000 ng/ml of standard was pipetted into well A2, 500 ng/ml of standard was pipetted into well A3, and 250 ng/ml of standard was pipetted into well A4. PicoGreen (Molecular Probes, Eugene, Oreg.) was thawed and freshly diluted 1:200 according to the number of plates that were being measured. PicoGreen was vortexed and then 50 µl was pipetted into all wells of the black plate with the diluted DNA. DNA and PicoGreen were mixed by pipetting repeatedly at least 10 times with the multichannel pipette. The plate was placed into a Fluoroskan Ascent Machine (microplate fluorometer produced by Labsystems) and the samples were allowed to incubate for 3 minutes before the machine was run using filter pairs 485 nm excitation and 538 nm emission wavelengths. Samples having measured DNA concentrations of greater than 450 ng/µl were re-measured for conformation. Samples having measured DNA concentrations of 20 ng/µl or less were re-measured for confirmation.

Pooling Strategies

Samples were placed into one of two groups based on disease status. The two groups were female case groups and female control groups. A select set of samples from each group were utilized to generate pools, and one pool was created for each group. Each individual sample in a pool was represented by an equal amount of genomic DNA. For example, where 25 ng of genomic DNA was utilized in each PCR reaction and there were 200 individuals in each pool, each individual would provide 125 pg of genomic DNA. Inclusion or exclusion of samples for a pool was based upon the following criteria: the sample was derived from an individual characterized as Caucasian; the sample was derived from an individual of German paternal and maternal descent; the database included relevant phenotype information for the individual; case samples were derived from individuals diagnosed with breast cancer; control samples were derived from individuals free of cancer and no family history of breast cancer; and sufficient genomic DNA was extracted from each blood sample for all allelotyping and genotyping reactions performed during the study. Phenotype information included pre- or post-menopausal, familial predisposition, country or origin of mother and father, diagnosis with breast cancer (date of primary diagnosis, age of individual as of primary diagnosis, grade or stage of development, occurrence of metastases, e.g., lymph node metastases, organ metastases), condition of body tissue (skin tissue, breast tissue, ovary tissue, peritoneum tissue and myometrium), method of treatment (surgery, chemotherapy, hormone therapy, radiation therapy). Samples that met these criteria were added to appropriate pools based on gender and disease status.

The selection process yielded the pools set forth in Table 1, which were used in the studies that follow:

TABLE 1

|  | Female CASE | Female CONTROL |
| --- | --- | --- |
| Pool size (Number) | 272 | 276 |
| Pool Criteria (ex: case/control) | case | control |
| Mean Age (ex: years) | 59.6 | 55.4 |

Example 2

Association of Polymorphic Variants with Breast Cancer

A whole-genome screen was performed to identify particular SNPs associated with occurrence of breast cancer. As described in Example 1, two sets of samples were utilized, which included samples from female individuals having breast cancer (breast cancer cases) and samples from female individuals not having cancer (female controls). The initial screen of each pool was performed in an allelotyping study, in which certain samples in each group were pooled. By pooling DNA from each group, an allele frequency for each SNP in each group was calculated. These allele frequencies were then compared to one another. Particular SNPs were considered as being associated with breast cancer when allele frequency differences calculated between case and control pools were statistically significant. SNP disease association results obtained from the allelotyping study were then validated by genotyping each associated SNP across all samples from each pool. The results of the genotyping were then analyzed, allele frequencies for each group were calculated from the individual genotyping results, and a p-value was calculated to determine whether the case and control groups had statistically significantly differences in allele frequencies for a particular SNP. When the genotyping results agreed with the original allelotyping results, the SNP disease association was considered validated at the genetic level.

SNP Panel Used for Genetic Analyses

A whole-genome SNP screen began with an initial screen of approximately 25,000 SNPs over each set of disease and control samples using a pooling approach. The pools studied in the screen are described in Example 1. The SNPs analyzed in this study were part of a set of 25,488 SNPs confirmed as being statistically polymorphic as each is characterized as having a minor allele frequency of greater than 10%. The SNPs in the set reside in genes or in close proximity to genes, and many reside in gene exons. Specifically, SNPs in the set are located in exons, introns, and within 5,000 base-pairs upstream of a transcription start site of a gene. In addition, SNPs were selected according to the following criteria: they are located in ESTs; they are located in Locuslink or Ensemble genes; and they are located in Genomatix promoter predictions. SNPs in the set also were selected on the basis of even spacing across the genome, as depicted in Table 2.

A case-control study design using a whole genome association strategy involving approximately 28,000 single nucleotide polymorphisms (SNPs) was employed. Approximately 25,000 SNPs were evenly spaced in gene-based regions of the human genome with a median inter-marker distance of about 40,000 base pairs. Additionally, approximately 3,000 SNPs causing amino acid substitutions in genes described in the literature as candidates for various diseases were used. The case-control study samples were of female German origin (German paternal and maternal descent) 548 individuals were equally distributed in two groups (female controls and female cases). The whole genome association approach was first conducted on 2 DNA pools representing the 2 groups. Significant markers were confirmed by individual genotyping.

TABLE 2

| General Statistics | | Spacing Statistics | |
| --- | --- | --- | --- |
| Total # of SNPs | 25,488 | Median | 37,058 bp |
| # of Exonic SNPs | >4,335 (17%) | Minimum* | 1,000 bp |
| # SNPs with refSNP ID | 20,776 (81%) | Maximum* | 3,000,000 bp |
| Gene Coverage | >10,000 | Mean | 122,412 bp |
| Chromosome Coverage | All | Std Deviation | 373,325 bp |

*Excludes outliers

Allelotyping and Genotyping Results

The genetic studies summarized above and described in more detail below identified allelic variants associated with breast cancer. The allelic variants identified from the SNP panel described in Table 2 are summarized below in Table 3.

TABLE 3

| SNP Reference | Chromosome Position | Position in Figure | Contig Identification | Contig Position | Sequence Identification | Locus | Sequence Position | Allelic Variability |
| --- | --- | --- | --- | --- | --- | --- | --- | --- |
| 1056538 | 10248147 | 44247 | NT_011295 |  | NM_000201 | ICAM region |  | C/T |
| 1541998 | 87342924 | 36424 | NT_016354 | 11444849 | NM_002753 | MAPK10 | intragenic | C/T |

TABLE 3-continued

| SNP Reference | Chromosome Position | Position in Figure | Contig Identification | Contig Position | Sequence Identification | Locus | Sequence Position | Allelic Variability |
|---|---|---|---|---|---|---|---|---|
| 2001449 | 184330963 | 48563 | NT_005962 | 18141399 | NM_015078 | KIAA0861 | intragenic | G/C |
| 673478 | 72021802 | 49002 | NT_033927 | 1998133 | NM_006185 | NUMA1 | | T/C |
| | | | | | NM_017907 | FLJ20625 | downstream | |
| | | | | | NM_145309 | LOC220074 | | |
| 4237 | 10291777 | 87877 | NT_004391 | 454476 | NM_000403 | GALE | downstream | A/G |
| | | | NT_004610 | | NM_020362 | HT014 | | |
| | | | NO. INFO. | | NO INFO. | LOC148902 | | |
| | | | NT_004610 | | NM_007260 | LYPLA2 | | |

Table 3 includes information pertaining to the incident polymorphic variant associated with breast cancer identified herein. Public information pertaining to the polymorphism and the genomic sequence that includes the polymorphism are indicated. The genomic sequences identified in Table 3 may be accessed at the world wide web address ncbi.nih.gov/entrez/query.fcgi, for example, by using the publicly available SNP reference number (e.g., rs1541998). The chromosome position refers to the position of the SNP within NOBI's Genome Build 33, which may be accessed at the following world wide web address ncbi.nlm.nih.gov/mapview/map_search cgi?chr=hum_chr.inf&query=. The "Contig Position" provided in Table 3 corresponds to a nucleotide position set forth in the contig sequence, and designates the polymorphic site corresponding to the SNP reference number. The sequence containing the polymorphisms also may be referenced by the "Sequence Identification" set forth in Table ing a polymorphic site of interest. A third primer (the Mass EXTEND™ primer), which is complementary to the amplified target up to but not including the polymorphism, was then enzymatically extended one or a few bases through the polymorphic site and then terminated.

For each polymorphism, SpectroDESIGNER™ software (Sequenom, Inc.) was used to generate a set of PCR primers and a MassEXTEND™ primer was used to genotype the polymorphism. Table 4 shows PCR primers and Table 5 shows extension primers used for analyzing polymorphisms. The initial PCR amplification reaction was performed in a 5 μl total volume containing 1×PCR buffer with 1.5 mM MgCl₂ (Qiagen), 200 μM each of dATP, dGTP, dCTP, dTTP (Gibco-BRL), 2.5 ng of genomic DNA, 0.1 units of HotStar DNA polymerase (Qiagen), and 200 nM each of forward and reverse PCR primers specific for the polymorphic region of interest.

TABLE 4

PCR Primers

| Reference SNP ID | Forward PCR primer | SEQ ID NO | Reverse PCR primer | SEQ ID NO. |
|---|---|---|---|---|
| 1056538 | GACAGCCACAGCTAGCGCAGA | 19 | TGTTTTCGCCCCCCAGGGTGAC | 20 |
| 1541998 | CTGATTATTCTGATGGTAATG | 21 | GCCCATGTTAACATTTTCTTC | 22 |
| 2001449 | ATGTCAAGTGCACCCACATG | 23 | AGGAAGAAACTGACGGAAGG | 24 |
| 673478 | TAATACAAAGGTGGCAGCAG | 25 | TTGACAAGGATAAGGACAAG | 26 |
| 4237 | GCACATGGCCACATTAACTGG | 27 | TGGCTGTGGAAATTGGGTCTTG | 28 |

3. The "Sequence Identification" corresponds to cDNA sequence that encodes associated target polypeptides (e.g., NUMA1) of the invention. The position of the SNP within the cDNA sequence is provided in the "Sequence Position" column of Table 3. Also, the allelic variation at the polymorphic site and the allelic variant identified as associated with breast cancer is specified in Table 3. All nucleotide sequences referenced and accessed by the parameters set forth in Table 3 are incorporated herein by reference. The positions for these SNPs are indicated in the tables below in FIGS. 1, 2, 3 and 4, and the incident SNP for the GALE region is at position 174 in FIG. 5.

Assay for Verifying, Allelotyping, and Genotyping SNPs

A MassARRAY™ system (Sequenom, Inc.) was utilized to perform SNP genotyping in a high-throughput fashion. This genotyping platform was complemented by a homogeneous, single-tube assay method (hME™ or homogeneous MassEXTEND™ (Sequenom, Inc.)) in which two genotyping primers anneal to and amplify a genomic target surround- Samples were incubated at 95° C. for 15 minutes, followed by 45 cycles of 95° C. for 20 seconds, 56° C. for 30 seconds, and 72° C. for 1 minute, finishing with a 3 minute final extension at 72° C. Following amplification, shrimp alkaline phosphatase (SAP) (0.3 units in a 2 μl volume) (Amersham Pharmacia) was added to each reaction (total reaction volume was 7 μl) to remove any residual dNTPs that were not consumed in the PCR step. Samples were incubated for 20 minutes at 37° C., followed by 5 minutes at 85° C. to denature the SAP.

Once the SAP reaction was complete, a primer extension reaction was initiated by adding a polymorphism-specific MassEXTEND™ primer cocktail to each sample. Each Mass EXTEND™ cocktail included a specific combination of dideoxynucleotides (ddNTPs) and deoxynucleotides (dNTPs) used to distinguish polymorphic alleles from one another. In Table 5, ddNTPs are shown and the fourth nucleotide not shown is the dNTP.

TABLE 5

Extend Primers

| Reference SNP ID | Extend Probe | SEQ ID NO. | Term Mix |
|---|---|---|---|
| 1056538 | CCCAGGGTGACGTTGCAGA | 29 | ACG |
| 1541998 | ATTATTCTGATGGTAATGATCCAG | 30 | ACG |
| 2001449 | CACATGCCTGCTCGCCCCC | 31 | ACT |
| 673478 | AAGGGGAGGTCGACTGGG | 32 | ACT |
| 4237 | GGCATCTGGCAGTCATGG | 33 | ACT |

The MassEXTEND™ reaction was performed in a total volume of 9 µl, with the addition of 1× ThermoSequenase buffer, 0.576 units of ThermoSequenase (Amersham Pharmacia), 600 nM MassEXTEND™ primer, 2 mM of ddATP and/or ddCTP and/or ddGTP and/or ddTTP, and 2 mM of dATP or dCTP or dGTP or dTTP. The deoxy nucleotide (dNTP) used in the assay normally was complementary to the nucleotide at the polymorphic site in the amplicon. Samples were incubated at 94° C. for 2 minutes, followed by 55 cycles of 5 seconds at 94° C., 5 seconds at 52° C., and 5 seconds at 72° C.

Following incubation, samples were desalted by adding 16 µl of water (total reaction volume was 25 µl), 3 mg of SpectroCLEAN™ sample cleaning beads (Sequenom, Inc.) and allowed to incubate for 3 minutes with rotation. Samples were then robotically dispensed using a piezoelectric dispensing device (SpectroJET™ (Sequenom, Inc.)) onto either 96-spot or 384-spot silicon chips containing a matrix that crystallized each sample (SpectroCHIP™ (Sequenom, Inc.)). Subsequently, MALDI-TOF mass spectrometry (Biflex and Autoflex MALDI-TOF mass spectrometers (Bruker Daltonics) can be used) and SpectroTYPER RT™ software (Sequenom, Inc.) were used to analyze and interpret the SNP genotype for each sample.

Genetic Analysis

Variations identified in the target genes are provided in their respective genomic sequences (see FIGS. 1-5) Minor allelic frequencies for these polymorphisms was verified as being 10% or greater by determining the allelic frequencies using the extension assay described above in a group of samples isolated from 92 individuals originating from the state of Utah in the United States, Venezuela and France (Coriell cell repositories).

Genotyping results are shown for female pools in Table 6A and 6B. Table 6A shows the original genotyping results and Table 6B shows the genotyped results re-analyzed to remove duplicate individuals from the cases and controls (i.e., individuals who were erroneously included more than once as either cases or controls). Therefore, Table 6B represents a more accurate measure of the allele frequencies for this particular SNP. In the subsequent tables, "AF" refers to allelic frequency; and "F case" and "F control" refer to female case and female control groups, respectively.

TABLE 6A

| Reference SNP ID | AF F case | AF F control | p-value | Odds Ratio | Breast Cancer Assoc. Allele |
|---|---|---|---|---|---|
| 1056538 | C = 0.651<br>T = 0.349 | C = 0.564<br>T = 0.436 | 0.0038 | 0.69 | C |
| 1541998 | T = 0.780<br>C = 0.220 | T = 0.839<br>C = 0.161 | 0.0153 | 0.69 | C |
| 2001449 | G = 0.703<br>C = 0.297 | G = 0.780<br>C = 0.220 | 0.0040 | 1.49 | C |
| 673478 | T = 0.919<br>C = 0.081 | T = 0.953<br>C = 0.047 | 0.0238 | 1.74 | C |
| 4237 | A = 0.590<br>G = 0.410 | A = 0.530<br>G = 0.470 | 0.0431 | 0.78 | A |

TABLE 6B

| Reference SNP ID | AF F case | AF F control | p-value | Odds Ratio | Breast Cancer Assoc. Allele |
|---|---|---|---|---|---|
| 1056538 | C = 0.658<br>T = 0.342 | C = 0.556<br>T = 0.444 | 0.0012 | 0.65 | C |
| 1541998 | T = 0.771<br>C = 0.229 | T = 0.839<br>C = 0.161 | 0.0070 | 0.65 | C |
| 2001449 | G = 0.693<br>C = 0.307 | G = 0.782<br>C = 0.218 | 0.0012 | 1.59 | C |
| 673478 | T = 0.916<br>C = 0.084 | T = 0.953<br>C = 0.047 | 0.0171 | 1.85 | C |
| 4237 | A = 0.584<br>G = 0.416 | A = 0.527<br>G = 0.473 | 0.0704 | 0.79 | A |

The single marker alleles set forth in Table 3 were considered validated, since the genotyping data for the females, males or both pools were significantly associated with breast cancer, and because the genotyping results agreed with the original allelotyping results. Particularly significant associations with breast cancer are indicated by a calculated p-value of less than 0.05 for genotype results, which are set forth in bold text.

Odds ratio results are shown in Tables 6A and 6B. An odds ratio is an unbiased estimate of relative risk which can be obtained from most case-control studies. Relative risk (RR) is an estimate of the likelihood of disease in the exposed group (susceptibility allele or genotype carriers) compared to the unexposed group (not carriers). It can be calculated by the following equation:

$$RR = IA/Ia$$

IA is the incidence of disease in the A carriers and Ia is the incidence of disease in the non-carriers.

RR>1 indicates the A allele increases disease susceptibility.

RR<1 indicates the a allele increases disease susceptibility.

For example, RR=1.5 indicates that carriers of the A allele have 1.5 times the risk of disease than non-carriers, i.e., 50% more likely to get the disease.

Case-control studies do not allow the direct estimation of IA and Ia, therefore relative risk cannot be directly estimated. However, the odds ratio (OR) can be calculated using the following equation:

$$OR = (nDAnda)/(ndAnDa) = pDA(1-pdA)/pdA(1-pDA),$$
or $$OR = ((case\,f)/(1-case\,f))/((control\,f)/(1-control\,f)),$$
where f=susceptibility allele frequency.

An odds ratio can be interpreted in the same way a relative risk is interpreted and can be directly estimated using the data from case-control studies, i.e., case and control allele frequencies. The higher the odds ratio value, the larger the effect that particular allele has on the development of breast cancer. Possessing an allele associated with a relatively high odds ratio translates to having a higher risk of developing or having breast cancer.

Example 3

Samples and Pooling Strategies for the Replication Samples

The SNPs of Table 3 were genotyped again in a collection of replication samples to further validate its association with breast cancer. Like the original study population described in Examples 1 and 2, the replication samples consisted of females diagnosed with breast cancer (cases) and females without cancer (controls). The case and control samples were selected and genotyped as described below.

Pooling Strategies

Samples were placed into one of two groups based on disease status. The two groups were female case groups and female control groups. A select set of samples from each group were utilized to generate pools, and one pool was created for each group. Each individual sample in a pool was represented by an equal amount of genomic DNA. For example, where 25 ng of genomic DNA was utilized in each PCR reaction and there were 190 individuals in each pool (i.e., 190 cases and 190 controls), each individual would provide 125 pg of genomic DNA. Inclusion or exclusion of samples for a pool was based upon the following criteria: the sample was derived from a female individual characterized as Caucasian from Australia; case samples were derived from individuals diagnosed with breast cancer; control samples were derived from individuals free of cancer and no family history of breast cancer; and sufficient genomic DNA was extracted from each blood sample for all allelotyping and genotyping reactions performed during the study. Samples in the pools also were age-matched. Samples that met these criteria were added to appropriate pools based on gender and disease status.

The selection process yielded the pools set forth in Table 7, which were used in the studies that follow:

TABLE 7

|  | Female CASE | Female CONTROL |
|---|---|---|
| Pool size (Number) | 190 | 190 |
| Pool Criteria (ex: case/control) | Case | control |
| Mean Age (ex: years) | 64.5 | ** |

** Each case was matched by a control within 5 years of age of the case.

The replication genotyping results are shown in Table 8. The odds ratio was calculated as described in Example 2.

TABLE 8

| Reference SNP ID | AF F case | AF F control | p-value | Odds Ratio |
|---|---|---|---|---|
| 1056538 | C = 0.650 | C = 0.584 | 0.0624 | 0.75 |
|  | T = 0.350 | T = 0.416 |  |  |
| 1541998 | T = 0.820 | T = 0.864 | 0.1010 | 0.72 |
|  | C = 0.180 | C = 0.136 |  |  |

TABLE 8-continued

| Reference SNP ID | AF F case | AF F control | p-value | Odds Ratio |
|---|---|---|---|---|
| 2001449 | G = 0.685 | G = 0.777 | 0.005 | 1.59 |
|  | C = 0.315 | C = 0.223 |  |  |
| 673478 | T = 0.927 | T = 0.957 | 0.077 | 1.76 |
|  | C = 0.073 | C = 0.043 |  |  |
| 4237 | A = 0.632 | A = 0.577 | 0.1260 | 1.26 |
|  | G = 0.368 | G = 0.423 |  |  |

The absence of a statistically significant association in the replication cohort should not be interpreted as minimizing the value of the original finding. There are many reasons why a biologically derived association identified in a sample from one population would not replicate in a sample from another population. The most important reason is differences in population history. Due to bottlenecks and founder effects, there may be common disease predisposing alleles present in one population that are relatively rare in another, leading to a lack of association in the candidate region. Also, because common diseases such as breast cancer are the result of susceptibilities in many genes and many environmental risk factors, differences in population-specific genetic and environmental backgrounds could mask the effects of a biologically relevant allele. For these and other reasons, statistically strong results in the original, discovery sample that did not replicate in the replication sample may be further evaluated in additional replication cohorts and experimental systems.

Example 4

ICAM Region Proximal SNPs

It has been discovered that a polymorphic variation (rs1056538) in a region that encodes ICAM1, ICAM2, and ICAM5 is associated with the occurrence of breast cancer (see Examples 1 and 2). Subsequently, SNPs proximal to the incident SNP (rs1056538) were identified and allelotyped in breast cancer sample sets and control sample sets as described in Examples 1 and 2. Approximately seventy-five allelic variants located within the ICAM region were identified and allelotyped. The polymorphic variants are set forth in Table 9. The chromosome position provided in column four of Table 9 is based on Genome "Build 33" of NCBI's GenBank.

TABLE 9

| dbSNP rs# | Chromosome | Position in FIG. 1 | Chromosome Position | Allele Variants |
|---|---|---|---|---|
| 2884487 | 19 | 139 | 10204039 | T/C |
| 1059840 | 19 | 11799 | 10215699 | A/T |
| 11115 | 19 | 11851 | 10215751 | T/C |
| 1059849 | 19 | 11963 | 10215863 | G/A |
| 3093035 | 19 | 24282 | 10228182 | A/G |
| ICAM_SNPA | 19 | 26849 | 10230749 | A/T |
| 281428 | 19 | 29633 | 10233533 | C/T |
| 281431 | 19 | 31254 | 10235154 | T/C |
| ICAM_SNPB | 19 | 31967 | 10235867 | G/C |
| 2358581 | 19 | 32920 | 10236820 | G/T |
| 281434 | 19 | 33929 | 10237829 | A/G |
| ICAM_SNPC | 19 | 35599 | 10239499 | G/C |
| 1799969 | 19 | 36101 | 10240001 | G/A |
| 3093033 | 19 | 36340 | 10240240 | G/A |
| ICAM_SNPD | 19 | 36405 | 10240305 | A/G |
| ICAM_SNPE | 19 | 36517 | 10240417 | T/C |
| ICAM_SNPF | 19 | 36777 | 10240677 | A/G |
| 5498 | 19 | 36992 | 10240892 | G/A |
| ICAM_SNPG | 19 | 37645 | 10241545 | T/C |

TABLE 9-continued

| dbSNP rs# | Chromosome | Position in FIG. 1 | Chromosome Position | Allele Variants |
|---|---|---|---|---|
| 1057981 | 19 | 37868 | 10241768 | G/A |
| 281436 | 19 | 38440 | 10242340 | A/G |
| 923366 | 19 | 38532 | 10242432 | T/C |
| 281437 | 19 | 38547 | 10242447 | C/T |
| ICAM_SNPH | 19 | 38712 | 10242612 | T/C |
| 281438 | 19 | 40684 | 10244584 | T/G |
| 3093029 | 19 | 40860 | 10244760 | C/G |
| 2569693 | 19 | 41213 | 10245113 | C/T |
| 281439 | 19 | 41419 | 10245319 | G/C |
| 281440 | 19 | 41613 | 10245513 | G/A |
| ICAM_SNPI | 19 | 42407 | 10246307 | C/G |
| 1333881 | 19 | 43440 | 10247340 | T/C |
| 1056538 | 19 | 44247 | 10248147 | T/C |
| 2228615 | 19 | 44677 | 10248577 | A/G |
| 2569702 | 19 | 45256 | 10249156 | T/C |
| 2569703 | 19 | 45536 | 10249436 | C/G |
| ICAM_SNPJ | 19 | 46153 | 10250053 | C/T |
| 2569707 | 19 | 47546 | 10251446 | C/G |
| 2916060 | 19 | 47697 | 10251597 | A/C |
| 885743 | 19 | 47944 | 10251844 | A/T |
| ICAM_SNPK | 19 | 48530 | 10252430 | C/G |
| 892188 | 19 | 51102 | 10255002 | T/C |
| 2291473 | 19 | 57090 | 10260990 | T/C |
| 281416 | 19 | 60093 | 10263993 | A/G |
| 281417 | 19 | 60439 | 10264339 | T/C |
| 281418 | 19 | 62694 | 10266594 | G/C |
| 430092 | 19 | 66260 | 10270160 | C/T |
| 368835 | 19 | 67295 | 10271195 | A/G |
| 2358583 | 19 | 67304 | 10271204 | T/G |
| ICAM_SNPL | 19 | 67731 | 10271631 | G/T |
| 1045384 | 19 | 68555 | 10272455 | C/A |
| 281427 | 19 | 70429 | 10274329 | C/T |

TABLE 9-continued

| dbSNP rs# | Chromosome | Position in FIG. 1 | Chromosome Position | Allele Variants |
|---|---|---|---|---|
| 3745264 | 19 | 70875 | 10274775 | T/G |
| 281426 | 19 | 72360 | 10276260 | G/A |
| 281424 | 19 | 74228 | 10278128 | C/T |
| 281423 | 19 | 76802 | 10280702 | C/T |
| 281422 | 19 | 77664 | 10281564 | T/C |
| 281421 | 19 | 78803 | 10282703 | A/G |
| 281420 | 19 | 79263 | 10283163 | A/G |
| 3745263 | 19 | 80810 | 10284710 | A/G |
| 3745261 | 19 | 81020 | 10284920 | T/C |
| 3181049 | 19 | 82426 | 10286326 | T/C |
| 281412 | 19 | 82783 | 10286683 | T/C |
| 2230399 | 19 | 85912 | 10289812 | C/G |
| 2278442 | 19 | 86135 | 10290035 | G/A |
| 2304237 | 19 | 87877 | 10291777 | T/C |
| 281413 | 19 | 88043 | 10291943 | G/A |
| 1058154 | 19 | 88206 | 10292106 | A/C |
| 3176769 | 19 | 88343 | 10292243 | T/C |
| 2304240 | 19 | 90701 | 10294601 | G/A |
| 3176768 | 19 | 90974 | 10294874 | A/G |
| 3176767 | 19 | 91060 | 10294960 | C/A |
| 3176766 | 19 | 91087 | 10294987 | C/T |
| ICAM_SNPM | 19 | 91594 | 10295494 | G/A |
| 281415 | 19 | 92302 | 10296202 | T/G |
| 3176764 | 19 | 92384 | 10296284 | A/G |

Assay for Verifying and Allelotyping SNPs

The methods used to verify and allelotype the proximal SNPs of Table 9 are the same methods described in Examples 1 and 2 herein. The PCR primers and extend primers used in these assays are provided in Table 10 and Table 11, respectively.

TABLE 10

| dbSNP rs# | Forward PCR primer | SEQ ID NO. | Reverse PCR primer | SEQ ID No. |
|---|---|---|---|---|
| 5498 | ACGTTGGATGCTCACAGAGCACATTCACGG | 34 | ACGTTGGATGAGATCTTGAGGGCACCTACC | 35 |
| 11115 | ACGTTGGATGAGGTGACACCTTCCTCGAAG | 36 | ACGTTGGATGTGTGAAGCACCTCTTCTGAG | 37 |
| 11115 | ACGTTGGATGGTCCAGGTGACACCTTCCTC | 38 | ACGTTGGATGAAGCACCTCTTCTGAGCCAG | 39 |
| 56901 | ACGTTGGATGGTCCAGGTGACACCTTCCTC | 40 | ACGTTGGATGAAGCACCTCTTCTGAGCCAG | 41 |
| 240914 | ACGTTGGATGTTCAACAAGCGAGTGACAGC | 42 | ACGTTGGATGGTGCAGAGATGGCTTTCTC | 43 |
| 254615 | ACGTTGGATGTGTAGATGGTCACGTTCTCC | 44 | ACGTTGGATGATCTGAGTCCTGATGTCACC | 45 |
| 254615 | ACGTTGGATGTTGCAGCTTTAAGCTAAGGC | 46 | ACGTTGGATGAGCCCAGGAGACTTAATTAC | 47 |
| 272539 | ACGTTGGATGTACAGACCCCTCTACCCCTTC | 48 | ACGTTGGATGAGGTGACACCTTCCTCGAAG | 49 |
| 281412 | ACGTTGGATGTGACCTCAGGTGATTCACCC | 50 | ACGTTGGATGGGTATACCTTTAGCTGGCTG | 51 |
| 281413 | ACGTTGGATGTCAAAGCTCACAGTTCTCGG | 52 | ACGTTGGATGACTTAGCGGGTCCTGCAAAC | 53 |
| 281414 | ACGTTGGATGAAGGCACCTTCCTCTGTCAG | 54 | ACGTTGGATGTGGGCCACAACACGGATGGTA | 55 |
| 281415 | ACGTTGGATGGCACAAAGAGCTAAGGTAGG | 56 | ACGTTGGATGGAATCCTGGATAGACAGTGG | 57 |
| 281416 | ACGTTGGATGTAACGTAGAGCACAGGTGAG | 58 | ACGTTGGATGCAACGCAAACACCAGTGTGG | 59 |
| 281417 | ACGTTGGATGAAGAGACAGTGGAGAGGCTG | 60 | ACGTTGGATGAGAGCCATCGGGTCCCAGCAA | 61 |
| 281418 | ACGTTGGATGTGCGCTCAGTCAGCTTCCTC | 62 | ACGTTGGATGAGTGTTAGCCGAGGGCAAGC | 63 |
| 281420 | ACGTTGGATGCCAGGACTGTCTCTCTGTTT | 64 | ACGTTGGATGATGACACTACAGCCTGAGCA | 65 |
| 281421 | ACGTTGGATGAGTGTTGCTTTGTCACCCAG | 66 | ACGTTGGATGAGGAGAATCGCTTGTACCTG | 67 |
| 281422 | ACGTTGGATGAGAAATCCTCCTACCTTGGC | 68 | ACGTTGGATGGCCCGGCCTCTACATAAAAT | 69 |

TABLE 10-continued

| dbSNP rs# | Forward PCR primer | SEQ ID NO. | Reverse PCR primer | SEQ ID No. |
|---|---|---|---|---|
| 281423 | ACGTTGGATGAACCTCAAGCTGCTTCACTG | 70 | ACGTTGGATGGAGGAGCCCACCTTTAATGT | 71 |
| 281424 | ACGTTGGATGACCTGTGTTTCTAGGTGTGC | 72 | ACGTTGGATGCATGCCTGGGAAAAAACTCC | 73 |
| 281426 | ACGTTGGATGATCCTCACACCTCAGTCTCC | 74 | ACGTTGGATGAATGAGACTCCGTCTCTACC | 75 |
| 281427 | ACGTTGGATGGACAATTGTAGTACCCAGCC | 76 | ACGTTGGATGAGGAGAATCGCTTGAACCTG | 77 |
| 281428 | ACGTTGGATGAGTAGCTGGAATTACAGGCG | 78 | ACGTTGGATGGCCAACATGATGAAATCCCG | 79 |
| 281431 | ACGTTGGATGACTGGGATTACAGGTGTGAG | 80 | ACGTTGGATGGGAGAAATCTTGATGGAGGC | 81 |
| 281432 | ACGTTGGATGAGCTGGGACTTTCCTTCTTG | 82 | ACGTTGGATGCAGTAAATCCAGCCTTCAGC | 83 |
| 281434 | ACGTTGGATGCCACGCCTGGCTAATTTTTG | 84 | ACGTTGGATGGGTCAGGAGTTCAAGACCAG | 85 |
| 281436 | ACGTTGGATGCATGGTTCACTGCAGTCTTG | 86 | ACGTTGGATGTGTGGTGTTGTGAGCCTATG | 87 |
| 281437 | ACGTTGGATGATAGGCTCACAACACCACAC | 88 | ACGTTGGATGAACACAAAGGAAGTCTGGGC | 89 |
| 281437 | ACGTTGGATGATAGGCTCACAACACCACAC | 90 | ACGTTGGATGAACACAAAGGAAGTCTGGGC | 91 |
| 281438 | ACGTTGGATGACCTGAGGTTTCCTCACTCAG | 92 | ACGTTGGATGAGAGGTTTCTGTGACACCCG | 93 |
| 281439 | ACGTTGGATGGCGGAGCCATACCTCTAAGC | 94 | ACGTTGGATGTCGCTGGCACTTTCGTCCC | 95 |
| 281440 | ACGTTGGATGCTGGCTGAGATGCCATGATA | 96 | ACGTTGGATGATGGTGGGAGGAGCTAAATG | 97 |
| 281440 | ACGTTGGATGGCCATGATAATAAGCTGGAC | 98 | ACGTTGGATGTCTTAGTCCCCAAATGTATC | 99 |
| 368835 | ACGTTGGATGGGTGGGAAAAAGACGTGAAG | 100 | ACGTTGGATGAGAGGGAATTAAGGAGGTCC | 101 |
| 378395 | ACGTTGGATGAATTCCGTGGGATGAGGAAT | 102 | ACGTTGGATGACCGTGTTTTCCAGGCTCGCG | 103 |
| 378395 | ACGTTGGATGACTTGGCCCCCTGCACTCACA | 104 | ACGTTGGATGACCGTGTTTTCCAGGCTCGCG | 105 |
| 430092 | ACGTTGGATGGTTGGGATTACAGGCATGAG | 106 | ACGTTGGATGATCTGTTGCCTGTCAAGATG | 107 |
| 473241 | ACGTTGGATGGCCATGATAATAAGCTGGAC | 108 | ACGTTGGATGAAATGTATCCCCGCCCTAAG | 109 |
| 547878 | ACGTTGGATGTACTCAGGAGGCTGAGGTG | 110 | ACGTTGGATGCATGGTTCACTGCAGTCTTG | 111 |
| 827786 | ACGTTGGATGGCGGAGCCATACCTCTAAGC | 112 | ACGTTGGATGTCGCTGGCACTTTCGTCCC | 113 |
| 827787 | ACGTTGGATGCTGGCTGAGATGCCATGATA | 114 | ACGTTGGATGATGGTGGGAGGAGCTAAATG | 115 |
| 885743 | ACGTTGGATGTGAGAGAAGGCGATCTTGAC | 116 | ACGTTGGATGCCAATTCACAATCCACTGTG | 117 |
| 885743 | ACGTTGGATGTGAGAGAAGGCGATCTTGAC | 118 | ACGTTGGATGCCAATTCACAATCCACTGTG | 119 |
| 892188 | ACGTTGGATGGTTTGTTTTAGAGACAGGG | 120 | ACGTTGGATGGTCAAAGCCACTTCCAGCTA | 121 |
| 901886 | ACGTTGGATGCGATCTGGTCGCTCTGCAAG | 122 | ACGTTGGATGGCCCCACCTTCTGTTCCAAG | 123 |
| 923366 | ACGTTGGATGTCTGGGCAATGTTGCAAGAC | 124 | ACGTTGGATGATAGGCTCACAACACCACAC | 125 |
| 923366 | ACGTTGGATGTCTGGGCAATGTTGCAAGAC | 126 | ACGTTGGATGATAGGCTCACAACACCACAC | 127 |
| 1045384 | ACGTTGGATGGTGCAGAGATGGGCTTTCTC | 128 | ACGTTGGATGAGATGGGCACAATGTCCGAC | 129 |
| 1056538 | ACGTTGGATGACTGCCACAGCCACAGCTAG | 130 | ACGTTGGATGTTTTCGCCCCCAGGGTGA | 131 |
| 1057981 | ACGTTGGATGGTACAACTGTACCTGGTGAC | 132 | ACGTTGGATGAATGAACATAGGTCTCTGGC | 133 |
| 1058154 | ACGTTGGATGTCCCTTCCATCCTCATTTTT | 134 | ACGTTGGATGTGCAAGGCGCTAAACAAAAC | 135 |
| 1059840 | ACGTTGGATGTCGGCCTGGCTCAGAAGAGG | 136 | ACGTTGGATGACCCCTACCCCACGCTACCCA | 137 |
| 1059849 | ACGTTGGATGGGAATGGATGCAGAAGCCCG | 138 | ACGTTGGATGAAGCTGAGGCCACAGGGAG | 139 |
| 1059849 | ACGTTGGATGAATGGATGCAGAAGCCCGTC | 140 | ACGTTGGATGATTCCACGGAGGAAGCTGAG | 141 |
| 1333881 | ACGTTGGATGATCAGCTCTACGCGATCTGG | 142 | ACGTTGGATGTTCAGGCCCCACCTTCTGTTC | 143 |
| 1799969 | ACGTTGGATGTCAACCTCTGGTCCCCAGTG | 144 | ACGTTGGATGAGGGGACCGTGGTCTGTTC | 145 |

TABLE 10-continued

| dbSNP rs# | Forward PCR primer | SEQ ID NO. | Reverse PCR primer | SEQ ID No. |
|---|---|---|---|---|
| 1799969 | ACGTTGGATGTTGCCATAGGTGACTGTGGG | 146 | ACGTTGGATGTCCTAGAGGTGGACACGCAG | 147 |
| 2075741 | ACGTTGGATGAAGATGCCAGTCCGTGGACC | 148 | ACGTTGGATGCTGGAGACCCAGTGTCTCTC | 149 |
| 2228615 | ACGTTGGATGGGGCAGATGGTGACAGTAAC | 150 | ACGTTGGATGTGGAACTCCCTCCAGTGTGA | 151 |
| 2228615 | ACGTTGGATGGGGCAGATGGTGACAGTAAC | 152 | ACGTTGGATGTGGAACTCCCTCCAGTGTGA | 153 |
| 2230399 | ACGTTGGATGAGCGGCAGTTACCATGTTAG | 154 | ACGTTGGATGTTCTTCCCCCATTGCTTCTG | 155 |
| 2230399 | ACGTTGGATGAGCGGCAGTTACCATGTTAG | 156 | ACGTTGGATGTTCTTCCCCCATTGCTTCTG | 157 |
| 2278442 | ACGTTGGATGGGTGATGGACATTGAGGGTG | 158 | ACGTTGGATGTCCCTTCTGTCTCCAACCC | 159 |
| 2278442 | ACGTTGGATGTCGTGGTGATGGACATTGAG | 160 | ACGTTGGATGAAGTCAATATGCGTCCCTTC | 161 |
| 2291473 | ACGTTGGATGAAGAGGCTATGTGGCAGATG | 162 | ACGTTGGATGAGGGTGAAGCTGGGTTTAAC | 163 |
| 2304237 | ACGTTGGATGTGGGCCAGAACTTCACCCTG | 164 | ACGTTGGATGAAGCAGCACCACCGTGAGG | 165 |
| 2304240 | ACGTTGGATGAATCTCAGCAACGTGACTGG | 166 | ACGTTGGATGACACGGTGATGTTAGAGGAG | 167 |
| 2304240 | ACGTTGGATGAATCTCAGCAACGTGACTGG | 168 | ACGTTGGATGACACGGTGATGTTAGAGGAG | 169 |
| 2358581 | ACGTTGGATGTAAGGCAGGAGGATGGAGTG | 170 | ACGTTGGATGGACAGAGTCTCACTCTGTCG | 171 |
| 2358583 | ACGTTGGATGAAGACGTGAAGAGACACACC | 172 | ACGTTGGATGAGAGGGATTAAGGAGGTCC | 173 |
| 2569693 | ACGTTGGATGCTTGTTCTCGCGTGGATGTC | 174 | ACGTTGGATGTACTCAGCGTGTGTGAGCTC | 175 |
| 2569702 | ACGTTGGATGACCCTCCAGACCTTGAACCA | 176 | ACGTTGGATGACGTAACGCTAACGGTGGAG | 177 |
| 2569702 | ACGTTGGATGATACCCTACTCCTACTCTTC | 178 | ACGTTGGATGTCAAGGACGTAACGCTAACG | 179 |
| 2569703 | ACGTTGGATGTCAGGAAGCTCCCAGACAGA | 180 | ACGTTGGATGATAACCCTTGGACGCCGATC | 181 |
| 2569703 | ACGTTGGATGTTAGACGAAAAAGGCGCCAC | 182 | ACGTTGGATGTTGTCCCTGCATAACCCTTG | 183 |
| 2569707 | ACGTTGGATGTGAGCGTGGCAGGCGCCATG | 184 | ACGTTGGATGGCGTGGCGCCCGTGCGCGT | 185 |
| 2884487 | ACGTTGGATGTGTGGCAAATGATGGAACAG | 186 | ACGTTGGATGCCAGAAGTTTGAGATCTGCC | 187 |
| 2916060 | ACGTTGGATGGGCGAGGTATCTGAGAGGG | 188 | ACGTTGGATGTACTCTGTCCCACTTCCGTC | 189 |
| 3093029 | ACGTTGGATGGGCAGCTCTGATTGGATGTT | 190 | ACGTTGGATGCTCCACAGTTGTTTGGCCTC | 191 |
| 3093030 | ACGTTGGATGAGAGACCCAGAAGGTCATAG | 192 | ACGTTGGATGCCTCCCCCAAGAAAACATTG | 193 |
| 3093032 | ACGTTGGATGGGCCACTTCTTCTGTAAGTC | 194 | ACGTTGGATGCATGAGGACATACAACTGGG | 195 |
| 3093033 | ACGTTGGATGAAAGCCTGGAATAGGCACAC | 196 | ACGTTGGATGTGCAGACAGTGACCATCTAC | 197 |
| 3093035 | ACGTTGGATGGGAGACATAGCGAGATTCTG | 198 | ACGTTGGATGTAGAAAGCAGTGCGATCTGG | 199 |
| 3176764 | ACGTTGGATGAAATCGTTTGAACCCGGGAG | 200 | ACGTTGGATGGTTTTGAGACAGAGTCTCAC | 201 |
| 3176766 | ACGTTGGATGTTTCGGGCTGCAATGGTCCC | 202 | ACGTTGGATGTAACACCTCTCTCCTTGTGC | 203 |
| 3176767 | ACGTTGGATGCGGTCTCTGATGGATTCTAC | 204 | ACGTTGGATGAACAGGCCCACCATTTAAC | 205 |
| 3176768 | ACGTTGGATGGAGAGGTGTTAAATGGTGGG | 206 | ACGTTGGATGGGAACATGAAGAAGTCCTGG | 207 |
| 3176769 | ACGTTGGATGTTCCTGTTTATGGCCAGACG | 208 | ACGTTGGATGGTCTGAACCTGATTGGAGAG | 209 |
| 3181049 | ACGTTGGATGATCTTCAGGGATGGTCACTC | 210 | ACGTTGGATGGACAAATACAAAGGGACAGG | 211 |
| 3745261 | ACGTTGGATGACACACAGCAGGGCATCCGT | 212 | ACGTTGGATGCGCAATCAATGCTTTCCACC | 213 |
| 3745263 | ACGTTGGATGTACATGAAGAAGGACTCGGC | 214 | ACGTTGGATGATCCGTCCAGTGCACGTAGA | 215 |
| 3745264 | ACGTTGGATGCAAAGTGCTAGGATCACAGG | 216 | ACGTTGGATGACTGCCCCATAGAGTGGCAA | 217 |
| FCH-0994 | ACGTTGGATGTTTTCGCCCCCCAGGGTGAC | 218 | ACGTTGGATGACAGCCACAGCTAGCGCAGA | 219 |

TABLE 11

| dbSNP rs# | Extend Primer | SEQ ID NO. | Term Mix |
|---|---|---|---|
| 5498 | CAGAGCACATTCACGGTCACCT | 220 | CGT |
| 11115 | AAGGGTGGGCGTGGGCCT | 221 | ACT |
| 11115 | AAGGGTGGGCGTGGGCCT | 222 | ACT |
| 56901 | AAGGGTGGGCGTGGGCCT | 223 | ACT |
| 240914 | ACAATGTCCGACTCCACA | 224 | ACT |
| 254615 | CCAGGGTGACGTTGCAGA | 225 | ACG |
| 254615 | TAAGGCAAAGTTCAGCTACTTA | 226 | CGT |
| 272539 | ACCCCGTACCACTGTTGA | 227 | CGT |
| 281412 | GCTGGGATTATAAGCGTG | 228 | ACT |
| 281413 | GCTCACAGTTCTCGGCAGGAC | 229 | ACG |
| 281414 | CCTTCCTCTGTCAGAATGGC | 230 | ACG |
| 281415 | GGTGATTTGGGGACAGCTGA | 231 | ACT |
| 281416 | GGTCCACACCGACGCCAG | 232 | ACT |
| 281417 | CCCCTGCCCAGGACACCCC | 233 | ACT |
| 281418 | TCAGCTTCCTCCCTCCCC | 234 | ACT |
| 281420 | ACTGTCTCTCTGTTTTTGAGAT | 235 | ACT |
| 281421 | GCTTTGTCACCCAGGCTGGA | 236 | ACT |
| 281422 | CTGGGGAACTACAGGAATGC | 237 | ACT |
| 281423 | GCCCACCCTCCATTCAGC | 238 | ACG |
| 281424 | TAGGTGTGCGTGTGTGTG | 239 | ACG |
| 281426 | GAGCTGGGACCACAGGCA | 240 | ACG |
| 281427 | CTTTGTATACAATCTTCCCTC | 241 | ACG |
| 281428 | GCGCCCAGCACCACGCC | 242 | ACG |
| 281431 | ACAGGTGTGAGCCACTGC | 243 | ACT |
| 281432 | GGGAGTCATGGAGGGTTT | 244 | ACT |
| 281434 | TAGAGACGGGGTTTCACTAT | 245 | ACT |
| 281436 | ACTGCAGTCTTGACCTTTG | 246 | ACT |
| 281437 | TTTTTTTTCCAGAGACGGGTCT | 247 | ACG |
| 281437 | TTTTTCCAGAGACGGGTCT | 248 | ACG |
| 281438 | CGAAGCCCCAGACTCTGTGTA | 249 | ACT |
| 281439 | ACCCCTCCGGGTCAGCTCC | 250 | ACT |
| 281440 | TAATAAGCTGGACTCCGAGC | 251 | ACG |
| 281440 | TAATAAGCTGGACTCCGAGC | 252 | ACG |
| 368835 | AGACGTGAAGAGACACACCT | 253 | ACT |
| 378395 | GCCCGCGTCCTCCTCTCC | 254 | ACT |
| 378395 | GCCCGCGTCCTCCTCTCC | 255 | ACT |
| 430092 | ATTACAGGCATGAGCCACTG | 256 | ACG |
| 473241 | ATAATAAGCTGGACTCCGAGC | 257 | ACG |
| 547878 | GTGGGAGGATCACTTGAGC | 258 | ACG |
| 827786 | ACCCCTCCGGGTCAGCTCC | 259 | ACT |
| 827787 | TAATAAGCTGGACTCCGAGC | 260 | ACG |
| 885743 | GACCCCTCTCTCCCTCCA | 261 | CGT |
| 885743 | GACCCCTCTCTCCCTCCA | 262 | CGT |
| 892188 | TGGGCTGGAGCACAATGAC | 263 | ACT |
| 901886 | GAGTCCGCAGCTCTTTGAAC | 264 | ACT |
| 923366 | TTGCAAGACCCCGTCTCTG | 265 | ACT |
| 923366 | TTGCAAGACCCCGTCTCTG | 266 | ACT |
| 1045384 | CCAGTCCCTGCTGTCTGT | 267 | CGT |
| 1056538 | GAGGGTGCCAGGCAGCTG | 268 | ACT |
| 1057981 | TACCTGGTGACCTTGAATGTGAT | 269 | ACG |
| 1058154 | CTTCCATCCTCATTTTTTTTATT | 270 | ACT |
| 1059840 | GCTCAGAAGAGGTGCTTCAC | 271 | CGT |
| 1059849 | CAGAAGCCCGTCTGGGCT | 272 | ACG |
| 1059849 | CAGAAGCCCGTCTGGGCT | 273 | ACG |
| 1333881 | AGAGTCCGCAGCTCTTTGAAC | 274 | ACT |
| 1799969 | CCGAGACTGGGAACAGCC | 275 | ACG |
| 1799969 | CCGAGACTGGGAACAGCC | 276 | ACG |
| 2075741 | GGACCATGGTGCACAGCA | 277 | ACT |
| 2228615 | AGTAACCTGCGCAGCTGGG | 278 | ACT |
| 2228615 | GTAACCTGCGCAGCTGGG | 279 | ACT |
| 2230399 | GTTACCATGTTAGGGAGGAGA | 280 | ACT |
| 2230399 | ACCATGTTAGGGAGGAGA | 281 | ACT |
| 2278442 | GGACATTGAGGGTGAGCTAA | 282 | ACG |
| 2278442 | ACATTGAGGGTGAGCTAA | 283 | ACG |
| 2291473 | GGAGTGTCCCTGGACCCC | 284 | ACT |
| 2304237 | TGCGCTGCCAAGTGGAGG | 285 | ACT |
| 2304240 | GCTCAGTGTACTGCAATGGCTC | 286 | ACG |
| 2304240 | AGTGTACTGCAATGGCTC | 287 | ACG |
| 2358581 | CTTGCAGTGAGCCCAGATCG | 288 | CGT |
| 2358583 | AAGAGACACACCTAATTTGTGG | 289 | ACT |
| 2569693 | CGCGTGGATGTCAGGGCC | 290 | ACG |
| 2569702 | CAGACCTTGAACCAGATAGAA | 291 | ACT |
| 2569702 | ACCTTGAACCAGATAGAA | 292 | ACT |
| 2569703 | CTCCCAGACAGAGTGCATG | 293 | ACT |
| 2569703 | TCCCAGACAGAGTGCATG | 294 | ACT |
| 2569707 | GGCGAGTACGAGTGCGCA | 295 | ACT |

TABLE 11-continued

| dbSNP rs# | Extend Primer | SEQ ID NO. | Term Mix |
|---|---|---|---|
| 2884487 | AGAGACAGGGTCTCGCC | 296 | ACT |
| 2916060 | CTCCCTCTCGGTCCCGG | 297 | ACT |
| 3093029 | AGTTTCCTATCCCAGCC | 298 | ACT |
| 3093030 | CCAGAACCTCAGGGTATG | 299 | |
| 3093032 | CTTCTGTAAGTCTGTGGG | 300 | |
| 3093033 | GGGTTCAGGTCACACCC | 301 | ACG |
| 3093035 | TTCTGTCTCAAAAAACAAAGC | 302 | ACT |
| 3176764 | CCCGCCACTGCACTCCA | 303 | ACT |
| 3176766 | TCCTTCTGAGTTCTCCC | 304 | ACG |
| 3176767 | TGGATTCTACCTTTCCC | 305 | CGT |
| 3176768 | TGTTGATGCGTGGGTTGGGG | 306 | ACT |
| 3176769 | CGGGGTGGGTGGATCAA | 307 | ACT |
| 3181049 | ACTCCCTGCCCTGGCCC | 308 | ACT |
| 3745261 | GCAGCTGCACCGACAGTTC | 309 | ACT |
| 3745263 | TCGGCTGCCCGTGCCAAGTC | 310 | ACT |
| 3745264 | ATACCATGCCAGGCATT | 311 | ACT |
| FCH-0994 | CCCAGGGTGACGTTGCAGA | 312 | ACG |

Genetic Analysis of Allelotyping Results

Allelotyping results are shown for cases and controls in Table 12. The allele frequency for the A2 allele is noted in the fifth and sixth columns for breast cancer pools and control pools, respectively, where "AF" is allele frequency. The allele frequency for the A1 allele can be easily calculated by subtracting the A2 allele frequency from 1 (A1 AF=1–A2 AF). For example, the SNP rs2884487 has the following case and control allele frequencies: case A1 (T)=0.788; case A2 (C)=0.212; control A1 (T)=0.758; and control A2 (C)=0.242, where the nucleotide is provided in paranthesis. SNPs with blank allele frequencies were untyped.

TABLE 12

| dbSNP rs# | Position in FIG. 1 | Chromosome Position | A1/A2 Allele | A2 Case AF | A2 Control AF | p-Value |
|---|---|---|---|---|---|---|
| 2884487 | 139 | 10204039 | T/C | 0.212 | 0.242 | 0.2425 |
| 1059840 | 11799 | 10215699 | A/T | 0.809 | 0.805 | 0.8545 |
| 11115 | 11851 | 10215751 | T/C | 0.434 | 0.379 | 0.0644 |
| 1059849 | 11963 | 10215863 | G/A | 0.243 | 0.194 | 0.0468 |
| 3093035 | 24282 | 10228182 | A/G | 0.889 | 0.914 | 0.1592 |
| ICAM_SNPA | 26849 | 10230749 | A/T | Not Allelotyped | | |
| 281428 | 29633 | 10233533 | C/T | 0.180 | 0.174 | 0.7908 |
| 281431 | 31254 | 10235154 | T/C | 0.107 | 0.109 | 0.8964 |
| ICAM_SNPB | 31967 | 10235867 | G/C | 0.375 | 0.382 | 0.8113 |
| 2358581 | 32920 | 10236820 | G/T | 0.097 | 0.074 | 0.1800 |
| 281434 | 33929 | 10237829 | A/G | 0.818 | 0.831 | 0.5765 |
| ICAM_SNPC | 35599 | 10239499 | G/C | Not Allelotyped | | |
| 1799969 | 36101 | 10240001 | G/A | 0.117 | 0.151 | 0.1036 |
| 3093033 | 36340 | 10240240 | G/A | 0.004 | 0.023 | 0.0051 |
| ICAM_SNPD | 36405 | 10240305 | A/G | Not Allelotyped | | |
| ICAM_SNPE | 36517 | 10240417 | T/C | Not Allelotyped | | |
| ICAM_SNPF | 36777 | 10240677 | A/G | Not Allelotyped | | |
| 5498 | 36992 | 10240892 | G/A | 0.554 | 0.487 | 0.0257 |
| ICAM_SNPG | 37645 | 10241545 | T/C | 0.684 | 0.732 | 0.0788 |
| 1057981 | 37868 | 10241768 | G/A | 0.978 | 0.994 | 0.0289 |
| 281436 | 38440 | 10242340 | A/G | 0.504 | 0.554 | 0.0977 |
| 923366 | 38532 | 10242432 | T/C | 0.597 | 0.553 | 0.1471 |
| 281437 | 38547 | 10242447 | C/T | 0.195 | 0.151 | 0.0521 |
| ICAM_SNPH | 38712 | 10242612 | T/C | 0.448 | 0.398 | 0.0970 |
| 281438 | 40684 | 10244584 | T/G | 0.235 | 0.200 | 0.1589 |
| 3093029 | 40860 | 10244760 | C/G | 0.089 | 0.081 | 0.6267 |
| 2569693 | 41213 | 10245113 | C/T | 0.297 | 0.355 | 0.0389 |
| 281439 | 41419 | 10245319 | G/C | 0.526 | 0.589 | 0.0352 |
| 281440 | 41613 | 10245513 | G/A | 0.736 | 0.746 | 0.7085 |
| ICAM_SNPI | 42407 | 10246307 | C/G | 0.325 | 0.394 | 0.0173 |
| 1333881 | 43440 | 10247340 | T/C | 0.336 | 0.360 | 0.3961 |
| 1056538 | 44247 | 10248147 | T/C | 0.592 | 0.489 | 0.0009 |
| 2228615 | 44677 | 10248577 | A/G | 0.595 | 0.519 | 0.0112 |
| 2569702 | 45256 | 10249156 | T/C | 0.294 | 0.357 | 0.0254 |
| 2569703 | 45536 | 10249436 | C/G | 0.438 | 0.476 | 0.2109 |
| ICAM_SNPJ | 46153 | 10250053 | C/T | Not Allelotyped | | |
| 2569707 | 47546 | 10251446 | C/G | 0.829 | 0.840 | 0.6238 |
| 2916060 | 47697 | 10251597 | A/C | 0.010 | 0.002 | 0.0702 |
| 885743 | 47944 | 10251844 | A/T | Not Allelotyped | | |
| ICAM_SNPK | 48530 | 10252430 | C/G | Not Allelotyped | | |

TABLE 12-continued

| dbSNP rs# | Position in FIG. 1 | Chromosome Position | A1/A2 Allele | A2 Case AF | A2 Control AF | p-Value |
|---|---|---|---|---|---|---|
| 892188 | 51102 | 10255002 | T/C | 0.512 | 0.434 | 0.0104 |
| 2291473 | 57090 | 10260990 | T/C | 0.087 | 0.090 | 0.8770 |
| 281416 | 60093 | 10263993 | A/G | 0.546 | 0.505 | 0.1669 |
| 281417 | 60439 | 10264339 | T/C | 0.471 | 0.476 | 0.8531 |
| 281418 | 62694 | 10266594 | G/C | 0.914 | 0.934 | 0.1968 |
| 430092 | 66260 | 10270160 | C/T | 0.229 | 0.257 | 0.2758 |
| 368835 | 67295 | 10271195 | A/G | 0.703 | 0.727 | 0.3808 |
| 2358583 | 67304 | 10271204 | T/G | 0.304 | 0.326 | 0.4322 |
| ICAM_SNPL | 67731 | 10271631 | G/T | 0.705 | 0.669 | 0.2029 |
| 1045384 | 68555 | 10272455 | C/A | 0.180 | 0.187 | 0.7736 |
| 281427 | 70429 | 10274329 | C/T | 0.217 | 0.176 | 0.0916 |
| 3745264 | 70875 | 10274775 | T/G | 0.853 | 0.836 | 0.4285 |
| 281426 | 72360 | 10276260 | G/A | 0.565 | 0.685 | 0.0001 |
| 281424 | 74228 | 10278128 | C/T | 0.246 | 0.250 | 0.8929 |
| 281423 | 76802 | 10280702 | C/T | 0.192 | 0.197 | 0.8585 |
| 281422 | 77664 | 10281564 | T/C | 0.632 | 0.632 | 0.9791 |
| 281421 | 78803 | 10282703 | A/G | 0.920 | 0.925 | 0.7863 |
| 281420 | 79263 | 10283163 | A/G | 0.392 | 0.432 | 0.1774 |
| 3745263 | 80810 | 10284710 | A/G | 0.936 | 0.923 | 0.4005 |
| 3745261 | 81020 | 10284920 | T/C | 0.006 | 0.008 | 0.5979 |
| 3181049 | 82426 | 10286326 | T/C | 0.650 | 0.640 | 0.7183 |
| 281412 | 82783 | 10286683 | T/C | 0.408 | 0.352 | 0.0527 |
| 2230399 | 85912 | 10289812 | C/G | 0.826 | 0.838 | 0.5900 |
| 2278442 | 86135 | 10290035 | G/A | 0.581 | 0.594 | 0.6511 |
| 2304237 | 87877 | 10291777 | T/C | 0.102 | 0.093 | 0.6063 |
| 281413 | 88043 | 10291943 | G/A | Not Allelotyped | | |
| 1058154 | 88206 | 10292106 | A/C | 0.780 | 0.810 | 0.2203 |
| 3176769 | 88343 | 10292243 | T/C | 0.199 | 0.214 | 0.5539 |
| 2304240 | 90701 | 10294601 | G/A | 0.170 | 0.203 | 0.1661 |
| 3176768 | 90974 | 10294874 | A/G | 0.642 | 0.650 | 0.7681 |
| 3176767 | 91060 | 10294960 | C/A | 0.727 | 0.725 | 0.9511 |
| 3176766 | 91087 | 10294987 | C/T | 0.230 | 0.231 | 0.9513 |
| ICAM_SNPM | 91594 | 10295494 | G/A | 0.289 | 0.267 | 0.4128 |
| 281415 | 92302 | 10296202 | T/G | 0.754 | 0.766 | 0.6399 |
| 3176764 | 92384 | 10296284 | A/G | 0.899 | 0.894 | 0.8086 |
| 281412 | | NOT MAPPED | | 0.154 | 0.156 | 0.9342 |
| 281413 | | NOT MAPPED | | 0.299 | 0.302 | 0.9195 |
| 281415 | | NOT MAPPED | | 0.664 | 0.684 | 0.4825 |

FIG. 14 shows the proximal SNPs in and around the ICAM region for females. The position of each SNP on the chromosome is presented on the x-axis. The y-axis gives the negative logarithm (base 10) of the p-value comparing the estimated allele in the case group to that of the control group. The minor allele frequency of the control group for each SNP designated by an X or other symbol on the graphs in FIG. 14 can be determined by consulting Table 12. By proceeding down the Table from top to bottom and across the graphs from left to right the allele frequency associated with each symbol shown can be determined.

To aid the interpretation, multiple lines have been added to the graph. The broken horizontal lines are drawn at two common significance levels, 0.05 and 0.01. The vertical broken lines are drawn every 20 kb to assist in the interpretation of distances between SNPs. Two other lines are drawn to exposed linear trends in the association of SNPs to the disease. The light gray line (or generally bottom-most curve) is a nonlinear smoother through the data points on the graph using a local polynomial regression method (W. S. Cleveland, E. Grosse and W. M. Shyu (1992) Local regression models. Chapter 8 of Statistical Models in S eds J. M. Chambers and T. J. Hastie, Wadsworth & Brooks/Cole.). The black line (or generally top-most curve, e.g., see peak in left-most graph just to the left of position 92150000) provides a local test for excess statistical significance to identify regions of association. This was created by use of a 10 kb sliding window with 1 kb step sizes. Within each window, a chi-square goodness of fit test was applied to compare the proportion of SNPs that were significant at a test wise level of 0.01, to the proportion that would be expected by chance alone (0.05 for the methods used here). Resulting p-values that were less than $10^{-8}$ were truncated at that value.

Finally, the gene or genes present in the loci region of the proximal SNPs as annotated by Locus Link (http address: www.ncbi.nlm.nih.gov/LocusLink/) are provided on the graph. The exons and introns of the genes in the covered region are plotted below each graph at the appropriate chromosomal positions. The gene boundary is indicated by the broken horizontal line. The exon positions are shown as thick, unbroken bars. An arrow is place at the 3' end of each gene to show the direction of transcription.

Additional Genotyping

In addition to the ICAM region incident SNP, two other SNPs were genotyped in the discovery cohort. The discovery cohort is described in Example 1. The SNPs (rs1801714 and rs2228615) are located in the ICAM5 encoding portion of the sequence, were associated with breast cancer with a p-value of 0.0734 and 0.00236, respectively, and encoded non-synonymous amino acids (see Table 15).

The methods used to verify and genotype the two proximal SNPs of Table 15 are the same methods described in Examples 1 and 2 herein. The PCR primers and extend primers used in these assays are provided in Table 13 and Table 14, respectively.

TABLE 13

| dbSNP rs# | Second PCR primer | SEQ ID NO. | First PCR primer | SEQ ID NO. |
|---|---|---|---|---|
| 1801714 | ACGTTGGATGAGGGTTGCAGAGCAGGAGAA | 313 | ACGTTGGATGAGCCAAGGTGACGCTGAATG | 314 |
| 2228615 | ACGTTGGATGAGATGGTGACAGTAACCTGC | 315 | ACGTTGGATGTGGCATTTAGCTGAAGCTGG | 316 |

TABLE 14

| dbSNP rs# | Extend Primer | SEQ ID NO. | Term Mix |
|---|---|---|---|
| 1801714 | CCTTCAGCAGGAGCTGGGCCCTC | 317 | ACT |
| 2228615 | TAACCTGCGCAGCTGGG | 318 | ACT |

Table 15, below, shows the case and control allele frequencies along with the p-values for the SNPs genotyped. The disease associated allele of column 4 is in bold and the disease associated amino acid of column 5 is also in bold. The chromosome positions provided correspond to NCBI's Build 33.

TABLE 15

Genotyping Results

| dbSNP rs# | Position in FIG. 1 | Chromosome Position | Alleles (A1/A2) | Amino Acid Change | AF F case | AF F control | p-value | Odds Ratio |
|---|---|---|---|---|---|---|---|---|
| 1801714 | 36517 | 10240417 | T/C | L352P | T = 0.010<br>C = 0.990 | T = 0.030<br>C = 0.097 | 0.0734 | 2.260 |
| 2228615 | 44677 | 10248577 | A/G | T348A | A = 0.340<br>G = 0.660 | A = 0.430<br>G = 0.570 | 0.00236 | 1.470 |

Example 5

MAPK10 Proximal SNPs

It has been discovered that a polymorphic variation (rs1541998) in a region that encodes MAPK10 is associated with the occurrence of breast cancer (see Examples 1 and 2). Subsequently, SNPs proximal to the incident SNP (rs1541998) were identified and allelotyped in breast cancer sample sets and control sample sets as described in Examples 1 and 2. Approximately sixty-three allelic variants located within the MAPK10 region were identified and allelotyped. The polymorphic variants are set forth in Table 16. The chromosome position provided in column four of Table 16 is based on Genome "Build 33" of NCBI's GenBank.

TABLE 16

| dbSNP rs# | Chromosome | Position in FIG. 2 | Chromosome Position | Allele Variants |
|---|---|---|---|---|
| 2575681 | 4 | 191 | 87306691 | C/T |
| 2575680 | 4 | 1490 | 87307990 | A/G |
| 2589505 | 4 | 3781 | 87310281 | C/T |
| 2589504 | 4 | 3935 | 87310435 | G/A |
| 2164538 | 4 | 4512 | 87311012 | T/C |
| 2575679 | 4 | 7573 | 87314073 | A/G |
| MAP_SNP1 | 4 | 8467 | 87314967 | A/T |
| 2869408 | 4 | 9001 | 87315501 | C/G |
| 934648 | 4 | 9732 | 87316232 | T/C |
| 2164537 | 4 | 13477 | 87319977 | T/C |
| 2575678 | 4 | 13787 | 87320287 | A/C |
| 2575677 | 4 | 13903 | 87320403 | G/C |
| 2589509 | 4 | 14355 | 87320855 | T/G |
| 2164536 | 4 | 15053 | 87321553 | A/C |
| 2164535 | 4 | 15459 | 87321959 | T/A |
| MAP_SNP2 | 4 | 17762 | 87324262 | G/A |
| 2589523 | 4 | 19482 | 87325982 | C/T |
| 3755970 | 4 | 19631 | 87326131 | A/C |
| 2575675 | 4 | 22170 | 87328670 | G/A |
| 1202 | 4 | 22688 | 87329188 | T/C |
| 1201 | 4 | 22748 | 87329248 | A/G |
| 2589516 | 4 | 23376 | 87329876 | G/T |
| 2575674 | 4 | 23826 | 87330326 | A/T |
| 2589515 | 4 | 23868 | 87330368 | G/C |
| MAP_SNP3 | 4 | 24154 | 87330654 | C/T |
| 2589506 | 4 | 25972 | 87332472 | G/A |
| 1436524 | 4 | 26057 | 87332557 | A/G |
| 2575672 | 4 | 26361 | 87332861 | C/T |
| 2589518 | 4 | 26599 | 87333099 | G/A |
| 3775164 | 4 | 26712 | 87333212 | T/G |
| 2589514 | 4 | 26812 | 87333312 | G/A |
| 3775166 | 4 | 27069 | 87333569 | T/C |
| 3775167 | 4 | 32421 | 87338921 | C/T |
| 3775169 | 4 | 33557 | 87340057 | T/C |
| 2043650 | 4 | 35127 | 87341627 | A/G |
| 2043649 | 4 | 35222 | 87341722 | T/G |
| 3775170 | 4 | 35999 | 87342499 | T/A |
| 1541998 | 4 | 36424 | 87342924 | C/T |
| 2043648 | 4 | 37403 | 87343903 | A/G |
| 2282598 | 4 | 39203 | 87345703 | C/T |
| 2282597 | 4 | 39226 | 87345726 | G/A |
| 3775173 | 4 | 41147 | 87347647 | T/C |
| 1469870 | 4 | 46176 | 87352676 | G/C |
| 1436522 | 4 | 50452 | 87356952 | T/C |
| 1946733 | 4 | 52919 | 87359419 | G/A |
| 1436525 | 4 | 60214 | 87366714 | G/A |
| 3822037 | 4 | 61093 | 87367593 | C/G |
| 3775176 | 4 | 62572 | 87369072 | G/A |

TABLE 16-continued

| dbSNP rs# | Chromosome | Position in FIG. 2 | Chromosome Position | Allele Variants |
|---|---|---|---|---|
| 1436527 | 4 | 63601 | 87370101 | C/T |
| 1436529 | 4 | 65362 | 87371862 | T/C |
| 3775182 | 4 | 65863 | 87372363 | T/G |
| 3775183 | 4 | 66207 | 87372707 | G/A |
| 3775184 | 4 | 66339 | 87372839 | A/G |
| 3775187 | 4 | 69512 | 87376012 | T/C |
| 1010778 | 4 | 70759 | 87377259 | A/G |
| 2282596 | 4 | 71217 | 87377717 | T/A |
| 2118044 | 4 | 73382 | 87379882 | A/T |
| 1469869 | 4 | 76307 | 87382807 | C/T |
| 1046706 | 4 | Not mapped | | G/T |
| 2060588 | 4 | Not mapped | | G/A |
| 2289490 | 4 | Not mapped | | C/T |
| 2289491 | 4 | Not mapped | | C/T |
| 729511 | 4 | Not mapped | | T/C |

Assay for Verifying and Allelotyping SNPs

The methods used to verify and allelotype the proximal SNPs of Table 16 are the same methods described in Examples 1 and 2 herein. The PCR primers and extend primers used in these assays are provided in Table 17 and Table 18, respectively.

TABLE 17

| dbSNP rs# | Forward PCR primer | SEQ ID NO. | Reverse PCR primer | SEQ ID NO. |
|---|---|---|---|---|
| 958 | ACGTTGGATGATCCGCATGTGTCTGTATTC | 319 | ACGTTGGATGCCCAGTGCATTATGTCTTGG | 320 |
| 1201 | ACGTTGGATGTGCCAGTGCTCTGAAAACTG | 321 | ACGTTGGATGCCTGTGGTCTCTATTGCTTG | 322 |
| 1201 | ACGTTGGATGACAAGAATGCCAGTGCTCTG | 323 | ACGTTGGATGCCTGTGGTCTCTATTGCTTG | 324 |
| 1202 | ACGTTGGATGTAATCTCAGAATGGCAGCAC | 325 | ACGTTGGATGTCAAGCAATAGAGACCACAG | 326 |
| 10305 | ACGTTGGATGTTCAAGAATTATTTTATTGCAAGTC | 327 | ACGTTGGATGGGTGAAGCTTGAAAGCAAGC | 328 |
| 729511 | ACGTTGGATGTTAATGTAGTAAAAAGCACG | 329 | ACGTTGGATGCTAGAGATCGGTTTTACACC | 330 |
| 934648 | ACGTTGGATGACTGGTTGATACCATAGGAC | 331 | ACGTTGGATGTGTACTGCTTTCATCCTTGC | 332 |
| 934648 | ACGTTGGATGACTGGTTGATACCATAGGAC | 333 | ACGTTGGATGTGTACTGCTTTCATCCTTGC | 334 |
| 1010778 | ACGTTGGATGCAGAGGAAAGAAAACTGAAAG | 335 | ACGTTGGATGGGATTTGTTCTTAATCTTTC | 336 |
| 1046706 | ACGTTGGATGCAAATGGGAGTCAAGTCCTC | 337 | ACGTTGGATGTTTTGCTCCTAAGCTGAAGG | 338 |
| 1436522 | ACGTTGGATGGGAATTGAAATTGGCATTGC | 339 | ACGTTGGATGATTGGAAGGAGGAAGCATAG | 340 |
| 1436524 | ACGTTGGATGGAGTTGCCAGTAGCTTTGAG | 341 | ACGTTGGATGATTGTTTCCAGGGTGCTCTG | 342 |
| 1436525 | ACGTTGGATGGTGCAATCTTGGTTCACTGC | 343 | ACGTTGGATGGCTTACACTAGCTACTTGGG | 344 |
| 1436527 | ACGTTGGATGAGCACTGTGAGTTAAACCTG | 345 | ACGTTGGATGCTGTATAGAGAGCTGTTTGC | 346 |
| 1436529 | ACGTTGGATGCTATGGCAGCAGAAGAGTAG | 347 | ACGTTGGATGAATGTTGGACCACATGTACG | 348 |
| 1469869 | ACGTTGGATGCATGGCGAGGAAATCTGTTT | 349 | ACGTTGGATGTTCGATATATCAGAGCCTTG | 350 |
| 1469870 | ACGTTGGATGATACTGAGCTCCATTTTGGG | 351 | ACGTTGGATGATGGCACAGTTTAGCATGTC | 352 |
| 1541998 | ACGTTGGATGGCCCATGTTAACATTTCTTC | 353 | ACGTTGGATGCTGATTATTCTGATGGTAATG | 354 |
| 1946733 | ACGTTGGATGGCAGGAGGATAGATCTGTAG | 355 | ACGTTGGATGTAGCTTCTAAACATCTCTTG | 356 |
| 2043648 | ACGTTGGATGTGGCTTTCTGAATGCTAGAG | 357 | ACGTTGGATGAGGGCGGAATGATTTTTAGC | 358 |
| 2043649 | ACGTTGGATGGCACTACATGGGACACAAAG | 359 | ACGTTGGATGGTCCTACTAGTCCCTGTATG | 360 |
| 2043650 | ACGTTGGATGGCTGAGGGAGAAATTGAGTG | 361 | ACGTTGGATGCTGTGCCTTGCACATAGTAG | 362 |
| 2060588 | ACGTTGGATGTTTCATTGCTCATGGATTAG | 363 | ACGTTGGATGGATAAGTATTGGCTTAATCTG | 364 |
| 2118044 | ACGTTGGATGAACAACTTGGCTAATTCTAC | 365 | ACGTTGGATGGTCATTGCCTCTAGCTAGTG | 366 |
| 2164535 | ACGTTGGATGACCAGCACTATTACCCATGC | 367 | ACGTTGGATGGAATGATGTAAACGTTGGAG | 368 |
| 2164536 | ACGTTGGATGGTGATGAAAACCATGTGAGC | 369 | ACGTTGGATGCTGGAGAACAAAAGACCACC | 370 |
| 2164537 | ACGTTGGATGCAAGGCAAAATGTTTCCAGC | 371 | ACGTTGGATGAACACACTTAGTACCCACGC | 372 |
| 2164538 | ACGTTGGATGTACTGCAGAGCTCTCCCTTG | 373 | ACGTTGGATGAGAGGTCATCTTAATGGGCC | 374 |

TABLE 17-continued

| dbSNP rs# | Forward PCR primer | SEQ ID NO. | Reverse PCR primer | SEQ ID NO. |
|---|---|---|---|---|
| 2282596 | ACGTTGGATGTCATACTGATCAACCTGAAG | 375 | ACGTTGGATGGGTGGCTTTGTGAAACCTTG | 376 |
| 2282597 | ACGTTGGATGGCATGGTTCTGTTATAAGGC | 377 | ACGTTGGATGACACTTGATTACAATGGCCC | 378 |
| 2282598 | ACGTTGGATGCACGCCTAAGCAATTAATGAC | 379 | ACGTTGGATGGTGAATGAAGGAAAAGTAGC | 380 |
| 2289490 | ACGTTGGATGTGATTACTGGATTGGCTGGG | 381 | ACGTTGGATGAAATGCCCTGAAGACCCAGC | 382 |
| 2289491 | ACGTTGGATGGGAATGCATTGTAAACCAGG | 383 | ACGTTGGATGACCTAGCCTTGCAGGAGGAC | 384 |
| 2575672 | ACGTTGGATGATAGTGTTATCACATAGACC | 385 | ACGTTGGATGCTCCAGGAGCAAGGATTATG | 386 |
| 2575674 | ACGTTGGATGGTGGGTAACAGTTTTCAGGC | 387 | ACGTTGGATGCTCTCCTACTCTTTACTGTC | 388 |
| 2575675 | ACGTTGGATGTCGTACCTGCATAAGTGGTG | 389 | ACGTTGGATGTTGGGAAGGTACTAACAGCG | 390 |
| 2575677 | ACGTTGGATGGATGCCAATTTGGTTTGCCC | 391 | ACGTTGGATGGAAGGATAAGCCACAGTGAG | 392 |
| 2575678 | ACGTTGGATGCTTCAAGAGGCCATACAGAC | 393 | ACGTTGGATGAAGCACCATTTGTGGCTCAG | 394 |
| 2575679 | ACGTTGGATGCTTTCCTGCTGCATTTAGTG | 395 | ACGTTGGATGTAAGCCAGTAACACATGCCG | 396 |
| 2575680 | ACGTTGGATGGCCCTGAAGTTTTGAATGG | 397 | ACGTTGGATGGAGCCCAATACAATCAGGTG | 398 |
| 2575681 | ACGTTGGATGTTCACTGCTAACATGCATGG | 399 | ACGTTGGATGTTATATAGCCTTCTTTTCTC | 400 |
| 2589504 | ACGTTGGATGGGATAGGAAACATATTAAGG | 401 | ACGTTGGATGCTGTGTGATTTGGACAACCC | 402 |
| 2589505 | ACGTTGGATGAGACTGTAGCCTAAATGAGG | 403 | ACGTTGGATGCATTTTATGAGAAGATGCAC | 404 |
| 2589506 | ACGTTGGATGGCAACTCAGCTAGCCTTTAC | 405 | ACGTTGGATGTGTTATGCGGGAGTATAAGG | 406 |
| 2589509 | ACGTTGGATGTGAATCATGGTTGCCTCCTG | 407 | ACGTTGGATGATACGCAGGTTGTAGAGAGG | 408 |
| 2589514 | ACGTTGGATGTATACATTGTCCTGATAGAG | 409 | ACGTTGGATGCTTAAATGTCTCTAGAAAGG | 410 |
| 2589515 | ACGTTGGATGCACCTGTATACCAATTTGTAG | 411 | ACGTTGGATGGCCAAACCATTTTGTGCCTG | 412 |
| 2589516 | ACGTTGGATGCATACTCTGCCAAAGTTTTA | 413 | ACGTTGGATGACTCACACTGTGGTTTGGGG | 414 |
| 2589518 | ACGTTGGATGCCAGGCAAAAAGAATGACCG | 415 | ACGTTGGATGAATGATATGCACCGATCTTC | 416 |
| 2589523 | ACGTTGGATGTCATGTAGCTAAACAAAGGC | 417 | ACGTTGGATGAGCAGGGTTAAATTTCCCAG | 418 |
| 2589525 | ACGTTGGATGAAGAACATTGAAAGAAGCAG | 419 | ACGTTGGATGGTATTTAAATTAGTGGTGTG | 420 |
| 2869408 | ACGTTGGATGTCCCAGTACCTAAGTAGCAG | 421 | ACGTTGGATGGCTTTGAATTACTCTGTCCC | 422 |
| 3755970 | ACGTTGGATGTACAACTAGTATCTACAGAC | 423 | ACGTTGGATGGTGACCATGTAGAAATCTGTG | 424 |
| 3775164 | ACGTTGGATGGAACATGAAAAATTCATAAGC | 425 | ACGTTGGATGAAGTTTCCCTGGTCGTGATC | 426 |
| 3775166 | ACGTTGGATGCTGTTTTCACCCCCGATTC | 427 | ACGTTGGATGCTGAGGAGTCCATCATAGTG | 428 |
| 3775167 | ACGTTGGATGGAAACAAGCAGATGTCATGG | 429 | ACGTTGGATGGCTTCTGATTTTATATGGCAC | 430 |
| 3775169 | ACGTTGGATGGGGAGAGAATGGTTGCATAT | 431 | ACGTTGGATGATGCTGAACAACAGGATGGG | 432 |
| 3775170 | ACGTTGGATGCCTAAGACCTATGCTCTCAC | 433 | ACGTTGGATGCCCATTTTTGCTAGCAGGAG | 434 |
| 3775173 | ACGTTGGATGCAAGAGGGCTGCTTTAAACC | 435 | ACGTTGGATGTAAATTTGCAGAGGCCGTCG | 436 |
| 3775176 | ACGTTGGATGAAAAGGTCACCAGTGACCTG | 437 | ACGTTGGATGTAGTCCAAGTATTTCCCAAG | 438 |
| 3775182 | ACGTTGGATGGATATCTCCCTCCTATTGGC | 439 | ACGTTGGATGGCTGGACTCTATTAGGCCAT | 440 |
| 3775183 | ACGTTGGATGGATCTCTGATCTTAGACCAC | 441 | ACGTTGGATGTGCAGATATGTAGGCCAAGC | 442 |
| 3775184 | ACGTTGGATGGACCAGCAACCATGATGAAG | 443 | ACGTTGGATGGTTCTACTTTGACCACAGGC | 444 |
| 3775187 | ACGTTGGATGTAGCACCTTCAGGATCTTTC | 445 | ACGTTGGATGAATCATGATCCCAGGGCAAG | 446 |
| 3822037 | ACGTTGGATGGTAATCCATAAACTGTGGGAG | 447 | ACGTTGGATGTCCCACCCTGACTTCTTTGC | 448 |

TABLE 18

| dbSNP rs# | Extend Primer | SEQ ID NO. | Term Mix |
|---|---|---|---|
| 958 | TTATGTCTTGGTAGAGCC | 449 | ACG |
| 1201 | TCTATTGCTTGAAGAGAGAAAG | 450 | ACT |
| 1201 | TTGCTTGAAGAGAGAAAG | 451 | ACT |
| 1202 | CCACCTGCACCATCGCCAT | 452 | ACT |
| 10305 | AGCTAAATTGCAACAACA | 453 | ACG |
| 729511 | ATTGAACTGTATACTTAAAAATGC | 454 | ACT |
| 934648 | ACTCTCCCACTGAGCAAGC | 455 | ACT |
| 934648 | ACTCTCCCACTGAGCAAGC | 456 | ACT |
| 1010778 | TTGAAATACTGTTTGTTTCCCCAA | 457 | ACT |
| 1046706 | TCCTAAGCTGAAGGGAATGC | 458 | CGT |
| 1436522 | GAGGAAGCATAGATTTGGTGT | 459 | ACT |
| 1436524 | CCAGGGTGCTCTGGTTTAATT | 460 | ACT |
| 1436525 | GGCTTAAACCTGGGAGG | 461 | ACG |
| 1436527 | GAGCTGTTTGCATTTATAACTCA | 462 | ACG |
| 1436529 | ACCACATGTACGTAAGGGGA | 463 | ACT |
| 1469869 | AAACACCATCTACTCTGAAGAA | 464 | ACG |
| 1469870 | CTTATATTCTCTGTGGCACCAA | 465 | ACT |
| 1541998 | ATTATTCTGATGGTAATGATCCAG | 466 | ACG |
| 1946733 | CTAAACATCTCTTGAATATTCTG | 467 | ACG |
| 2043648 | TGATTTTTAGCTAAAGGGGACA | 468 | ACT |
| 2043649 | CCTCTTGTCTTATTATCCC | 469 | ACT |
| 2043650 | GCACATAGTAGTAGCTCA | 470 | ACT |
| 2060588 | ATTGGCTTAATCTGTACATCAATT | 471 | ACG |
| 2118044 | GTGGGGTTAGATATTATTTCCTGA | 472 | CGT |
| 2164535 | GATAAATGTGAGATTGAGAGA | 473 | CGT |
| 2164536 | CCTGTGTTCCTTTGTATTTATAT | 474 | ACT |
| 2164537 | CGGCTTCTACTCTCTTATTCA | 475 | ACT |
| 2164538 | GTCACATTCTTACCCTC | 476 | ACT |
| 2282596 | GAAACCTTGCATGAACT | 477 | CGT |
| 2282597 | CAGAAGCTACTTTTCCTTCA | 478 | ACG |
| 2282598 | AGGAAAAGTAGCTTCTGGG | 479 | ACG |
| 2289490 | GCTAGACTCCTGATACC | 480 | ACG |
| 2289491 | GGCTTGCTCCTGGTAATTTA | 481 | ACG |
| 2575672 | CAAGGATTATGTTAACCACT | 482 | ACG |
| 2575674 | TATTCACACCTGCCTTC | 483 | CGT |
| 2575675 | GTTCTTGCCTGGTTTAC | 484 | ACG |
| 2575677 | GGAATGAGGGCAACAGGA | 485 | ACT |
| 2575678 | TGTGGCTCAGGTCCAGG | 486 | ACT |
| 2575679 | CTTCCTGGACATTAAATTGT | 487 | ACT |
| 2575680 | GGATGCATGGTTTCTCTAAT | 488 | ACT |
| 2575681 | TTCTTTTCTCTTTTAGGAATCT | 489 | ACG |
| 2589504 | GTGCTAGGATCCTCAGT | 490 | ACG |
| 2589505 | GTTTTAGCATAATTGCTTCTTTA | 491 | ACG |
| 2589506 | GAGAAGAAACCTGCCCA | 492 | ACG |
| 2589509 | AGGGCTGCAGGGAAGAT | 493 | ACT |
| 2589514 | AGAAAAGGTTTTTAAAGTCCTC | 494 | ACG |
| 2589515 | GAAAACTGTTACCCACTC | 495 | ACT |
| 2589516 | GGTTTGGGGGTTTCATT | 496 | CGT |
| 2589518 | TGCACCGATCTTCAAATAAA | 497 | ACG |
| 2589523 | TTTCCCAGATTAATTATCAGATT | 498 | ACG |
| 2589525 | TTAGTGGTGTGACTTGCA | 499 | ACG |
| 2869408 | CGAATCTCTTTAACTGCTG | 500 | ACT |
| 3755970 | GGTTTCTTCTAAAACTGACCT | 501 | ACT |
| 3775164 | TTTTTTGGGATCTTGATATTTTA | 502 | ACT |
| 3775166 | AACTTATGAAAGAATATGAAGGAT | 503 | ACT |
| 3775167 | TAAGAGAAGTCTTCAGTGCTT | 504 | ACG |
| 3775169 | GCAGAGATTTTTCAAAATCTCTAA | 505 | ACT |
| 3775170 | TTTTTAAAGCTGAAAATAAACCA | 506 | CGT |
| 3775173 | GCCGTCGAACAAATACT | 507 | ACT |
| 3775176 | TATTTCCCAAGTGCCCA | 508 | ACG |
| 3775182 | CTGTCAGTTGCCTTAGG | 509 | ACT |
| 3775183 | AGTCAAGACCAGCTGGG | 510 | ACG |
| 3775184 | CTCTTTCTTCTGATCCC | 511 | ACT |
| 3775187 | AGTGCATTACAGTGGTC | 512 | ACT |
| 3822037 | TTTGCTTATTTCATAGAAGGAAT | 513 | ACT |

Genetic Analysis of Allelotyping Results

Allelotyping results are shown for cases and controls in Table 19. The allele frequency for the A2 allele is noted in the fifth and sixth columns for breast cancer pools and control pools, respectively, where "AF" is allele frequency. The allele frequency for the A1 allele can be easily calculated by subtracting the A2 allele frequency from 1 (A1 AF=1−A2 AF). For example, the SNP rs2575681 has the following case and control allele frequencies: case A1 (C)=0.611; case A2 (T)=0.389; control A1 (C)=0.632; and control A2 (T)=0.368, where the nucleotide is provided in paranthesis. SNPs with blank allele frequencies were untyped.

TABLE 19

| dbSNP rs# | Position in FIG. 2 | Chromosome Position | A1/A2 Allele | A2 Case AF | A2 Control AF | p-Value |
|---|---|---|---|---|---|---|
| 2575681 | 191 | 87306691 | C/T | 0.389 | 0.368 | 0.483 |
| 2575680 | 1490 | 87307990 | A/G | 0.599 | 0.585 | 0.646 |
| 2589505 | 3781 | 87310281 | C/T | 0.484 | 0.493 | 0.753 |
| 2589504 | 3935 | 87310435 | G/A | 0.258 | 0.274 | 0.563 |
| 2164538 | 4512 | 87311012 | T/C | 0.403 | 0.412 | 0.784 |
| 2575679 | 7573 | 87314073 | A/G | 0.020 | 0.003 | 0.006 |
| MAP_SNP1 | 8467 | 87314967 | A/T | 0.704 | 0.682 | 0.441 |
| 2869408 | 9001 | 87315501 | C/G | 0.708 | 0.716 | 0.777 |
| 934648 | 9732 | 87316232 | T/C | 0.655 | 0.664 | 0.741 |
| 2164537 | 13477 | 87319977 | T/C | 0.262 | 0.306 | 0.109 |
| 2575678 | 13787 | 87320287 | A/C | 0.110 | 0.078 | 0.065 |
| 2575677 | 13903 | 87320403 | G/C | 0.920 | 0.991 | 0.000 |
| 2589509 | 14355 | 87320855 | T/G | 0.198 | 0.209 | 0.668 |
| 2164536 | 15053 | 87321553 | A/C | 0.623 | 0.605 | 0.534 |
| 2164535 | 15459 | 87321959 | T/A | 0.573 | 0.571 | 0.944 |
| MAP_SNP2 | 17762 | 87324262 | G/A | 0.389 | 0.401 | 0.693 |
| 2589523 | 19482 | 87325982 | C/T | 0.779 | 0.813 | 0.156 |
| 3755970 | 19631 | 87326131 | A/C | 0.118 | 0.107 | 0.563 |
| 2575675 | 22170 | 87328670 | G/A | 0.656 | 0.694 | 0.176 |
| 1202 | 22688 | 87329188 | T/C | 0.764 | 0.762 | 0.933 |
| 1201 | 22748 | 87329248 | A/G | 0.128 | 0.117 | 0.579 |
| 2589516 | 23376 | 87329876 | G/T | 0.427 | 0.478 | 0.086 |
| 2575674 | 23826 | 87330326 | A/T | 0.583 | 0.666 | 0.004 |
| 2589515 | 23868 | 87330368 | G/C | 0.413 | 0.461 | 0.106 |
| MAP_SNP3 | 24154 | 87330654 | C/T | 0.175 | 0.158 | 0.430 |
| 2589506 | 25972 | 87332472 | G/A | 0.435 | 0.491 | 0.063 |
| 1436524 | 26057 | 87332557 | A/G | 0.660 | 0.756 | 0.001 |
| 2575672 | 26361 | 87332861 | C/T | 0.274 | 0.185 | 0.001 |
| 2589518 | 26599 | 87333099 | G/A | 0.194 | 0.130 | 0.004 |
| 3775164 | 26712 | 87333212 | T/G | 0.073 | 0.080 | 0.644 |
| 2589514 | 26812 | 87333312 | G/A | 0.445 | 0.358 | 0.004 |
| 3775166 | 27069 | 87333569 | T/C | 0.249 | 0.167 | 0.001 |
| 3775167 | 32421 | 87338921 | C/T | 0.156 | 0.152 | 0.882 |
| 3775169 | 33557 | 87340057 | T/C | 0.169 | 0.130 | 0.067 |
| 2043650 | 35127 | 87341627 | A/G | 0.697 | 0.787 | 0.001 |
| 2043649 | 35222 | 87341722 | T/G | 0.698 | 0.763 | 0.016 |
| 3775170 | 35999 | 87342499 | T/A | 0.207 | 0.220 | 0.596 |
| 1541998 | 36424 | 87342924 | C/T | 0.715 | 0.772 | 0.029 |
| 2043648 | 37403 | 87343903 | A/G | 0.424 | 0.466 | 0.159 |
| 2282598 | 39203 | 87345703 | C/T | 0.022 | 0.031 | 0.324 |
| 2282597 | 39226 | 87345726 | G/A | 0.817 | 0.802 | 0.541 |
| 3775173 | 41147 | 87347647 | T/C | 0.158 | 0.148 | 0.645 |
| 1469870 | 46176 | 87352676 | G/C | 0.118 | 0.063 | 0.002 |
| 1436522 | 50452 | 87356952 | T/C | 0.165 | 0.120 | 0.036 |
| 1946733 | 52919 | 87359419 | G/A | 0.240 | 0.226 | 0.588 |
| 1436525 | 60214 | 87366714 | G/A | 0.054 | 0.039 | 0.212 |
| 3822037 | 61093 | 87367593 | C/G | 0.956 | 0.918 | 0.010 |
| 3775176 | 62572 | 87369072 | G/A | 0.969 | 0.909 | 0.000 |
| 1436527 | 63601 | 87370101 | C/T | 0.288 | 0.251 | 0.175 |
| 1436529 | 65362 | 87371862 | T/C | 0.555 | 0.534 | 0.481 |
| 3775182 | 65863 | 87372363 | T/G | 0.858 | 0.870 | 0.568 |
| 3775183 | 66207 | 87372707 | G/A | 0.565 | 0.617 | 0.080 |
| 3775184 | 66339 | 87372839 | A/G | 0.174 | 0.185 | 0.634 |
| 3775187 | 69512 | 87376012 | T/C | 0.307 | 0.291 | 0.575 |
| 1010778 | 70759 | 87377259 | A/G | 0.330 | 0.275 | 0.048 |
| 2282596 | 71217 | 87377717 | T/A | 0.735 | 0.738 | 0.892 |
| 2118044 | 73382 | 87379882 | A/T | 0.352 | 0.319 | 0.248 |
| 1469869 | 76307 | 87382807 | C/T | 0.388 | 0.335 | 0.069 |
| 1046706 | Not mapped | | G/T | 0.538 | 0.533 | 0.866 |
| 2060588 | Not mapped | | G/A | 0.188 | 0.135 | 0.016 |
| 2289490 | Not mapped | | C/T | 0.780 | 0.812 | 0.187 |
| 2289491 | Not mapped | | C/T | 0.960 | 0.971 | 0.297 |
| 729511 | Not mapped | | T/C | 0.864 | 0.866 | 0.914 |

Finally, the gene or genes present in the loci region of the proximal SNPs as annotated by Locus Link (world wide web address ncbi.nlm.nih.gov/LocusLink/) are provided on the graph. The exons and introns of the genes in the covered region are plotted below each graph at the appropriate chromosomal positions. The gene boundary is indicated by the broken horizontal line. The exon positions are shown as thick, unbroken bars. An arrow is place at the 3' end of each gene to show the direction of transcription.

To aid the interpretation, multiple lines have been added to the graph. The broken horizontal lines are drawn at two common significance levels, 0.05 and 0.01. The vertical broken lines are drawn every 20 kb to assist in the interpretation of distances between SNPs. Two other lines are drawn to expose linear trends in the association of SNPs to the disease. The light gray line (or generally bottom-most curve) is a nonlinear smoother through the data points on the graph using a local polynomial regression method (W. S. Cleveland, E. Grosse and W. M. Shyu (1992) Local regression models. Chapter 8 of Statistical Models in S eds J. M. Chambers and T. J. Hastie, Wadsworth & Brooks/Cole.). The black line (or generally top-most curve, e.g., see peak in left-most graph just to the left of position 92150000) provides a local test for excess statistical significance to identify regions of association. This was created by use of a 10 kb sliding window with 1 kb step sizes. Within each window, a chi-square goodness of fit test was applied to compare the proportion of SNPs that were significant at a test wise level of 0.01, to the proportion that would be expected by chance alone (0.05 for the methods used here). Resulting p-values that were less than $10^{-8}$ were truncated at that value.

Finally, the gene or genes present in the loci region of the proximal SNPs as annotated by Locus Link (world wide web address ncbi.nlm.nih.gov/LocusLink/) are provided on the graph. The exons and introns of the genes in the covered region are plotted below each graph at the appropriate chromosomal positions. The gene boundary is indicated by the broken horizontal line. The exon positions are shown as thick, unbroken bars. An arrow is place at the 3' end of each gene to show the direction of transcription.

Example 6

KIAA0861 Proximal SNPs

It has been discovered that a polymorphic variation (rs2001449) in a gene encoding KIAA0861 is associated with the occurrence of breast cancer (see Examples 1 and 2). Subsequently, SNPs proximal to the incident SNP (rs2001449) were identified and allelotyped in breast cancer sample sets and control sample sets as described in Examples 1 and 2. A total of sixty-three allelic variants located within or nearby the KIAA0861 gene were identified and fifty-severn allelic variants were allelotyped. The polymorphic variants are set forth in Table 20. The chromosome position provided in columns four of Table 20 is based on Genome "Build 33" of NCBI's GenBank.

TABLE 20

| dbSNP rs# | Chromosome | Position in FIG. 3 | Chromosome Position | Allele Variants |
|---|---|---|---|---|
| 3811729 | 3 | 107 | 184282507 | A/G |
| 693208 | 3 | 2157 | 184284557 | C/G |
| 488277 | 3 | 7300 | 184289700 | T/C |
| 645039 | 3 | 8233 | 184290633 | T/C |
| 670232 | 3 | 9647 | 184292047 | A/T |

TABLE 20-continued

| dbSNP rs# | Chromosome | Position in FIG. 3 | Chromosome Position | Allele Variants |
|---|---|---|---|---|
| 575326 | 3 | 9868 | 184292268 | T/C |
| 575386 | 3 | 9889 | 184292289 | C/G |
| 471365 | 3 | 10621 | 184293021 | G/C |
| 496251 | 3 | 11003 | 184293403 | G/A |
| 831246 | 3 | 11507 | 184293907 | T/C |
| 831247 | 3 | 11527 | 184293927 | G/C |
| 831249 | 3 | 11718 | 184294118 | C/T |
| 831250 | 3 | 11808 | 184294208 | T/C |
| 831252 | 3 | 12024 | 184294424 | T/C |
| 512071 | 3 | 13963 | 184296363 | C/T |
| 1502761 | 3 | 14300 | 184296700 | A/C |
| 681516 | 3 | 14361 | 184296761 | C/T |
| 619424 | 3 | 16287 | 184298687 | T/G |
| 529055 | 3 | 18635 | 184301035 | A/G |
| 664010 | 3 | 19365 | 184301765 | T/G |
| 2653845 | 3 | 24953 | 184307353 | G/A |
| 472795 | 3 | 25435 | 184307835 | G/A |
| 507079 | 3 | 26847 | 184309247 | G/A |
| 534333 | 3 | 27492 | 184309892 | T/C |
| 831242 | 3 | 27620 | 184310020 | T/C |
| 536111 | 3 | 27678 | 184310078 | C/T |
| 536213 | 3 | 27714 | 184310114 | G/A |
| 831245 | 3 | 29719 | 184312119 | A/G |
| 639690 | 3 | 30234 | 184312634 | T/C |
| 684174 | 3 | 31909 | 184314309 | T/C |
| 571761 | 3 | 32153 | 184314553 | C/G |
| 1983421 | 3 | 33572 | 184315972 | T/C |
| 2314415 | 3 | 42164 | 184324564 | T/G |
| 2103062 | 3 | 43925 | 184326325 | A/G |
| 6804951 | 3 | 45031 | 184327431 | C/T |
| 1403452 | 3 | 45655 | 184328055 | T/C |
| 903950 | 3 | 48350 | 184330750 | C/A |
| 2017340 | 3 | 48418 | 184330818 | A/G |
| 2001449 | 3 | 48563 | 184330963 | G/C |
| 3821522 | 3 | 53189 | 184335589 | A/G |
| 1390831 | 3 | 56468 | 184338868 | T/G |
| 1353566 | 3 | 59358 | 184341758 | C/A |
| 1813856 | 3 | 63761 | 184346161 | C/T |
| 2272115 | 3 | 65931 | 184348331 | G/A |
| 3732603 | 3 | 67040 | 184349440 | G/C |
| 940055 | 3 | 69491 | 184351891 | A/C |
| 2314730 | 3 | 83308 | 184365708 | A/G |
| KIAA0861_3732602 | 3 | 126545 | 184408945 | C/T |
| KIAA0861_2293203 | 3 | 137592 | 184419992 | A/T |
| 7639705 | 3 | 147169 | 184429569 | G/T |

Assay for Verifying and Allelotyping SNPs

The methods used to verify and allelotype the sixty-three proximal SNPs of Table 20 are the same methods described in Examples 1 and 2 herein. The PCR primers and extend primers used in these assays are provided in Table 21 and Table 22, respectively.

TABLE 21

| dbSNP rs# | Forward PCR primer | SEQ ID NO. | Reverse PCR primer | SEQ ID NO. |
|---|---|---|---|---|
| 471365 | ACGTTGGATGTGAGTGACATTTGTGTCACC | 514 | ACGTTGGATGCGGAGGATCTGAACAACTTC | 515 |
| 472795 | ACGTTGGATGTCACCTGAGCATCAGACATG | 516 | ACGTTGGATGATAGTGGAAGGAGAAACGGG | 517 |
| 484315 | ACGTTGGATGGTTCTAATGTCACCCCTTCC | 518 | ACGTTGGATGCAATGTGGCAAATTCTCTGG | 519 |
| 488277 | ACGTTGGATGCACACATTCTTCTCAAGTGC | 520 | ACGTTGGATGGGAGGGACACAATTTAACTC | 521 |
| 496251 | ACGTTGGATGGGGAGTCATTCCAATACCAG | 522 | ACGTTGGATGGGAGTGAAAGGTCATATTGG | 523 |
| 502289 | ACGTTGGATGATCACTGCAACCTCCACCTC | 524 | ACGTTGGATGTGTGGCATGAGCCTGTAATC | 525 |
| 507079 | ACGTTGGATGAAGCCTCAGATGAGGCATAC | 526 | ACGTTGGATGTCTGAAAGGGTTCAGGAAGG | 527 |

TABLE 21-continued

| dbSNP rs# | Forward PCR primer | SEQ ID NO. | Reverse PCR primer | SEQ ID NO. |
|---|---|---|---|---|
| 512071 | ACGTTGGATGCAAATCACCCCTGACAATTC | 528 | ACGTTGGATGACCAGCACACTCAGCTTTAG | 529 |
| 519088 | ACGTTGGATGTCACCTGAGGTCAGGAGTTG | 530 | ACGTTGGATGAGGTTTCACCATGTTAGCCG | 531 |
| 529055 | ACGTTGGATGCTGCAGTTATCTGGGTGAGC | 532 | ACGTTGGATGCCAGAACGTGGCTTGTTGGG | 533 |
| 534333 | ACGTTGGATGCGTTGATGCACTGAAGGGAG | 534 | ACGTTGGATGAGAGGCTAAATGTTGGCAGG | 535 |
| 536111 | ACGTTGGATGTGTATCTGATCCCAGGTCAC | 536 | ACGTTGGATGATTGGTGTTAAGTGGCGTGC | 537 |
| 536213 | ACGTTGGATGTGAGGACCTCATTATTGGTG | 538 | ACGTTGGATGCTGAGCAATCGAACTGCTAC | 539 |
| 571761 | ACGTTGGATGAATATCCTAGGCTAGCAGTG | 540 | ACGTTGGATGGTGCATAAATACATGAATAG | 541 |
| 575326 | ACGTTGGATGACAGAGAGGCTTGGTCATAC | 542 | ACGTTGGATGGGTGCTTGGTTGTGATTCTC | 543 |
| 575386 | ACGTTGGATGATTCCTGCAGGTACTGTGTC | 544 | ACGTTGGATGTGAGCCCAAAACTACTGCTG | 545 |
| 578886 | ACGTTGGATGATGAAGTCTCGCTCTGTTGC | 546 | ACGTTGGATGAATCACTTGAACCCAGGAGG | 547 |
| 602646 | ACGTTGGATGTCTGGGACCGTTTACCGCA | 548 | ACGTTGGATGGAGGAGACCCAGGGTATGAG | 549 |
| 619424 | ACGTTGGATGACCGGGAGCTCCCAGTCTG | 550 | ACGTTGGATGTGGGAATCGGTTGAGAGCCG | 551 |
| 620722 | ACGTTGGATGTAAGGCGCCTGCAGAGGCGA | 552 | ACGTTGGATGGCAGCAAAGAATTGCCCGGC | 553 |
| 631755 | ACGTTGGATGATTTGTAGCTTTGCCCCAGC | 554 | ACGTTGGATGTTTGTGAGCTCCAAGTTGGG | 555 |
| 639690 | ACGTTGGATGGCATTTTACCACCATGTGGTT | 556 | ACGTTGGATGCCTTCATGTTAATTCTGCCC | 557 |
| 645039 | ACGTTGGATGCCTCTGAGTTCCCTCAGTTT | 558 | ACGTTGGATGTTATCACCCTGCTGTCCTAC | 559 |
| 664010 | ACGTTGGATGTGGTACCTCCAGGTAAAATG | 560 | ACGTTGGATGTCCAGGCAGTCATTTTACCC | 561 |
| 670232 | ACGTTGGATGGAAGGTGGAGCAGACATTAG | 562 | ACGTTGGATGACCTTAGTTATACCAGGCAC | 563 |
| 678454 | ACGTTGGATGTTAAGCCAGTCCCCACAAGG | 564 | ACGTTGGATGTTCTCTGCGGAGGAAAGTGC | 565 |
| 681516 | ACGTTGGATGCTCCTCCTCAGAGGACTAAC | 566 | ACGTTGGATGAGCCCAAGGACTCATACAAC | 567 |
| 683302 | ACGTTGGATGACCACGCCTGGCTAATTTTG | 568 | ACGTTGGATGAAACATGGCGAAACCCGGTC | 569 |
| 684174 | ACGTTGGATGCTTTACTGAGTGGGCAAACG | 570 | ACGTTGGATGTCTAAGTGGAACTCAGCAGC | 571 |
| 684846 | ACGTTGGATGAAGTTCCTCTGGTGGACAAC | 572 | ACGTTGGATGACCACCAGATAAAATCCCTC | 573 |
| 693208 | ACGTTGGATGTTTTGACAGGGCTTGAGTCC | 574 | ACGTTGGATGGCTGAAAGCCCTCAATCTAG | 575 |
| 831242 | ACGTTGGATGCAATTGCTCAGACCTTCACC | 576 | ACGTTGGATGAATGCTAGAGACATTGCACC | 577 |
| 831245 | ACGTTGGATGCTAGAATTACAGGTGCACAC | 578 | ACGTTGGATGGCCAAGATGGTGAAACCTTG | 579 |
| 831246 | ACGTTGGATGCACAATCTGTTAGAATGGTGG | 580 | ACGTTGGATGCGTCAAGACTGAATGCATAG | 581 |
| 831247 | ACGTTGGATGGAAAATATAGTCCTACACAA | 582 | ACGTTGGATGCGTCAAGACTGAATGCATAG | 583 |
| 831249 | ACGTTGGATGTCTCCTAATGCTATCCCTCC | 584 | ACGTTGGATGAACACATGGACACAGGAAGG | 585 |
| 831250 | ACGTTGGATGAGGGACATGGATGAAATTGG | 586 | ACGTTGGATGAATTCCCACCTATGAGTGAG | 587 |
| 831252 | ACGTTGGATGTGGGTATATACCCAAAGGAC | 588 | ACGTTGGATGGGTTGGTTCCAAGTCTTTGC | 589 |
| 903950 | ACGTTGGATGCTTCAGTTCAGGGAGAGATC | 590 | ACGTTGGATGATAGGGCCCCAGCATAAAA | 591 |
| 940054 | ACGTTGGATGTGGTAGAGATGAGGTCTTGC | 592 | ACGTTGGATGAAAGGCAGGAGGATTGCTTG | 593 |
| 940055 | ACGTTGGATGTATGCTTCCAGTCTCTGACC | 594 | ACGTTGGATGATAGGTAATCCAGTTGGGCC | 595 |
| 1353566 | ACGTTGGATGGGTGTACTCTGCCATTTGTC | 596 | ACGTTGGATGTGGAGGAGGTTCTAGTACCC | 597 |
| 1390831 | ACGTTGGATGGTCTGCCAAAGTTCCCTTAG | 598 | ACGTTGGATGAGGAAAGGGAAGAGAAACCG | 599 |
| 1403452 | ACGTTGGATGCAGAAGTTAGGATGCAGATG | 600 | ACGTTGGATGCCAGTAGAGATAGAATTTGG | 601 |
| 1502761 | ACGTTGGATGCAGAAATATGAAGGTGGCCC | 602 | ACGTTGGATGACCTTGAGCTCTGAGCCCTT | 603 |

TABLE 21-continued

| dbSNP rs# | Forward PCR primer | SEQ ID NO. | Reverse PCR primer | SEQ ID NO. |
|---|---|---|---|---|
| 1629673 | ACGTTGGATGAAGGATCACGTGAAGTCAGG | 604 | ACGTTGGATGGGCACCATGTGTGGCTAATT | 605 |
| 1813856 | ACGTTGGATGTCTGACTCCCTGATTCAAGC | 606 | ACGTTGGATGACAAAAATTAGCCGGGCGTG | 607 |
| 1983421 | ACGTTGGATGTCCAGGTGTTATGGAGTCAG | 608 | CGTTGGATGGGCTTCTTGTGCTGCTGTGT | 609 |
| 2001449 | ACGTTGGATGATGTCAAGTGCACCCACATG | 610 | ACGTTGGATGAGGAAGAAACTGACGGAAGG | 611 |
| 2017340 | ACGTTGGATGTATTCCACTGCCTGCTTTCC | 612 | ACGTTGGATGGAAAACAGGAGGAAGTGGTG | 613 |
| 2030578 | ACGTTGGATGTTCTCCACTTTCTGGTCAAC | 614 | ACGTTGGATGAACAACCTTACTTCATGCCC | 615 |
| 2049280 | ACGTTGGATGCTTCCCAACATTTTCGGCTC | 616 | ACGTTGGATGTGGATACTGAGGGTCAACTG | 617 |
| 2103062 | ACGTTGGATGTGCAGCCCTCAACCTTTCAG | 618 | ACGTTGGATGCCTTATTCAGTTACTATTACG | 619 |
| 2272115 | ACGTTGGATGAGTTGTGAGTGATTTCAGGG | 620 | ACGTTGGATGCAGGCCTTCTTGCTCTTATC | 621 |
| 2272116 | ACGTTGGATGATCTGTTGCCTTAGGTTCAC | 622 | ACGTTGGATGCTGTGCCTTCTGAGTAGTTC | 623 |
| 2314415 | ACGTTGGATGGGCTGAGTAACAGTCCATTG | 624 | ACGTTGGATGCTTACAGTATCCAAAAAGGG | 625 |
| 2314730 | ACGTTGGATGCTCAGGTAATCTGCCTTCTC | 626 | ACGTTGGATGCAGGGATAATGAGAACAAATC | 627 |
| 2653845 | ACGTTGGATGATCACTTGGACTCAGGAAGC | 628 | ACGTTGGATGAGTCTTGCTCTGTTTCCAGG | 629 |
| 3732603 | ACGTTGGATGCTCTCAATTCCATCAGTCTC | 630 | ACGTTGGATGCTTTACGAATTTCACAACAGG | 631 |
| 3811728 | ACGTTGGATGACGCGCCACACCTCCCTAC | 632 | ACGTTGGATGACGTGTCGGTCCCCTTTCAT | 633 |
| 3811729 | ACGTTGGATGTGGGCGAGGTTCTGCAGCGT | 634 | ACGTTGGATGGTTTCGTTTCTCCGGCACAG | 635 |
| 3811731 | ACGTTGGATGTGCGGTAAACGGTCCCAGAG | 636 | ACGTTGGATGAACTCCGCCGGCCCCCTCCTA | 637 |
| 3821522 | ACGTTGGATGAACCCGCACTACAAGATTCC | 638 | ACGTTGGATGGTCAGTCCCACATTCAGAAC | 639 |

TABLE 22

| dbSNP rs# | Extend Primer | SEQ ID NO. | Term Mix |
|---|---|---|---|
| 471365 | TCCAAAACCACCAGATAAAATC | 640 | ACT |
| 472795 | GACATGTCCCTCTCGGCCT | 641 | ACG |
| 484315 | GGTATCAGGAAGAGTCA | 642 | ACT |
| 488277 | AGTGCACACAGAACATTTAACA | 643 | ACT |
| 496251 | GTATTGTCCTCCAGTGA | 644 | ACG |
| 502289 | CTGTAATCCCAGCTACTC | 645 | ACT |
| 507079 | GGCAATGTTTGCCCTTT | 646 | ACG |
| 512071 | CCCTGACAATTCCAAAACTAA | 647 | ACG |
| 519088 | TTTCGCCATGTTTGCCAGG | 648 | ACG |
| 529055 | GAGCAGGCAGCACAAGT | 649 | ACT |
| 534333 | GGGAGAAAGTAACAGGGTC | 650 | ACT |
| 536111 | GTGAAGGTCTGAGCAAT | 651 | ACG |
| 536213 | TGGTGTTAAGTGGCGTG | 652 | ACG |
| 571761 | CTAGGCTAGCAGTGGGGTTG | 653 | ACT |
| 575326 | TGGTCATACCCTTCAAG | 654 | ACT |
| 575386 | GAAGGGTATGACCAAGC | 655 | ACT |
| 578886 | TGAGCCAAGATCATGCC | 656 | CGT |
| 602646 | CCAGGGTATGAGCGGAGGA | 657 | ACT |
| 619424 | TGCGGCCCCGCCGGGTT | 658 | ACT |
| 620722 | GAATTGCCCGGCTCCGAAT | 659 | ACT |
| 631755 | TCCAAGTTGGGTCAAAG | 660 | ACT |
| 639690 | CTGCTATTCATTTGTGTAGA | 661 | ACT |
| 645039 | CCCTCAGTTTTTATTGATTATT | 662 | ACT |
| 664010 | ACCTCCAGGTAAAATGATTAGTT | 663 | ACT |
| 670232 | TGGGCAAACAAGCCCAT | 664 | CGT |
| 678454 | CAGGGATGGTAATTGAC | 665 | ACG |
| 681516 | GGCCACCTTCATATTTC | 666 | ACG |
| 683302 | CAGGAGATCCAGACCATCCC | 667 | ACG |
| 684174 | CTCTGATGTTACCTCCTCC | 668 | ACT |
| 684846 | AGTTGTTCAGATCCTCC | 669 | ACT |

TABLE 22-continued

| dbSNP rs# | Extend Primer | SEQ ID NO. | Term Mix |
|---|---|---|---|
| 693208 | TCAATCTAGTGATAAGGAGGGT | 670 | ACT |
| 831242 | CAGGTGGATGGGGACAC | 671 | ACT |
| 831245 | CACACCACCACGCCCGGCT | 672 | ACT |
| 831246 | AGAATGGTGGTGTATTTTTAC | 673 | ACT |
| 831247 | TAGTCCTACACAATCTGTTA | 674 | ACT |
| 831249 | GCTATCCCTCCCCCCTTCCC | 675 | ACG |
| 831250 | GACAAAAAACCAAACACC | 676 | ACT |
| 831252 | CTATAAAGACACATGCACAC | 677 | ACT |
| 903950 | AGATCACATTGCCAACCCCA | 678 | CGT |
| 940054 | AAAGTAGCAGTTTGAGACCA | 679 | ACT |
| 940055 | GTCTCTGACCACTTGACCCA | 680 | ACT |
| 1353566 | TTGTCAGTTATGAGACCTTG | 681 | CGT |
| 1390831 | GGTTAGGAAGAAATCTGTG | 682 | ACT |
| 1403452 | CACAGATGCTCATGGGTCC | 683 | ACT |
| 1502761 | GGAGGAGGCACTATTAAT | 684 | ACT |
| 1629673 | TGTGGAGACAAGGTCTCACT | 685 | ACT |
| 1813856 | TCAAGCGATTCTCCTGC | 686 | ACG |
| 1983421 | GGCAGGGAAGAGAAGAGC | 687 | ACT |
| 2001449 | CACATGCCTGCTCGCCCC | 688 | ACT |
| 2017340 | CCCTAAAGCATCTCACAGCCCC | 689 | ACT |
| 2030578 | TCATGCCCATTGGGTTAG | 690 | ACT |

TABLE 22-continued

| dbSNP rs# | Extend Primer | SEQ ID NO. | Term Mix |
|---|---|---|---|
| 2049280 | GGGTCAACTGTACCAAG | 691 | ACG |
| 2103062 | GAGATCATTTCTCCTTCAAC | 692 | ACT |
| 2272115 | ATACCTCAGAATACAGCTTTTTTT | 693 | ACG |
| 2272116 | TCTCATTTCTCCTCTCTTTC | 694 | ACG |
| 2314415 | TAGTTGATGAAGATTTGGG | 695 | ACT |
| 2314730 | TCCTTCTTCTCTGCTTT | 696 | ACT |
| 2653845 | AAGCGGAGGTTGCAGTGAGC | 697 | ACG |
| 3732603 | CTCATTTCCACCCTTCT | 698 | ACT |
| 3811728 | GTCCCCTTTCATCTAAAC | 699 | ACT |
| 3811729 | TCTGCAGCGTGCGGCGA | 700 | ACT |
| 3811731 | CCTACCCCTACGGAGCC | 701 | ACT |
| 3821522 | GCATCTTCAGGAATCTTG | 702 | ACT |

Genetic Analysis of Allelotyping Results

Allelotyping results are shown for cases and controls in Table 23. The allele frequency for the A2 allele is noted in the fifth and sixth columns for breast cancer pools and control pools, respectively, where "AF" is allele frequency. The allele frequency for the A1 allele can be easily calculated by subtracting the A2 allele frequency from 1 (A1 AF=1−A2 AF). For example, the SNP in row 2 of Table 13 (rs3811729) has the following case and control allele frequencies: case A1 (A)=0.976; case A2 (G)=0.024; control A1 (A)=0.948; and control A2 (G)=0.052, where the nucleotide is provided in paranthesis. SNPs with blank allele frequencies were untyped ("not AT").

TABLE 23

| dbSNP rs# | Position in FIG. 3 | Chrom Position | Alleles (A1/A2) | A2 Case AF | A2 Control AF | p-Value |
|---|---|---|---|---|---|---|
| 3811729 | 107 | 184282507 | A/G | 0.024 | 0.052 | 0.017 |
| 693208 | 2157 | 184284557 | C/G | 0.186 | 0.207 | 0.368 |
| 3811731 | not mapped | | A/G | 0.690 | 0.641 | 0.084 |
| 602646 | not mapped | | C/G | 0.693 | 0.660 | 0.244 |
| 488277 | 7300 | 184289700 | T/C | 0.099 | 0.103 | 0.848 |
| 645039 | 8233 | 184290633 | T/C | 0.014 | 0.008 | 0.316 |
| 1629673 | not mapped | | T/C | 0.064 | 0.093 | 0.069 |
| 670232 | 9647 | 184292047 | A/T | 0.865 | 0.863 | 0.932 |
| 575326 | 9868 | 184292268 | T/C | 0.128 | 0.129 | 0.949 |
| 575386 | 9889 | 184292289 | C/G | 0.776 | 0.779 | 0.905 |
| 684846 | not mapped | | C/G | 0.799 | 0.745 | 0.033 |
| 471365 | 10621 | 184293021 | G/C | 0.746 | 0.740 | 0.815 |
| 496251 | 11003 | 184293403 | G/A | 0.156 | 0.160 | 0.853 |
| 831246 | 11507 | 184293907 | T/C | 0.773 | 0.802 | 0.243 |
| 831247 | 11527 | 184293927 | G/C | 0.829 | 0.826 | 0.879 |
| 831249 | 11718 | 184294118 | C/T | 0.071 | 0.051 | 0.160 |
| 831250 | 11808 | 184294208 | T/C | 0.682 | 0.697 | 0.589 |
| 831252 | 12024 | 184294424 | T/C | 0.752 | 0.762 | 0.695 |
| 512071 | 13963 | 184296363 | C/T | 0.616 | 0.642 | 0.367 |
| 1502761 | 14300 | 184296700 | A/C | 0.596 | 0.593 | 0.933 |
| 681516 | 14361 | 184296761 | C/T | 0.240 | 0.189 | 0.037 |
| 619424 | 16287 | 184298687 | T/G | 0.076 | 0.070 | 0.704 |
| 620722 | not mapped | | C/T | 0.779 | 0.819 | 0.100 |
| 529055 | 18635 | 184301035 | A/G | 0.601 | 0.637 | 0.219 |
| 664010 | 19365 | 184301765 | T/G | 0.455 | 0.394 | 0.039 |

TABLE 23-continued

| dbSNP rs# | Position in FIG. 3 | Chrom Position | Alleles (A1/A2) | A2 Case AF | A2 Control AF | p-Value |
|---|---|---|---|---|---|---|
| 678454 | not mapped | | T/G | 0.000 | 0.004 | 0.117 |
| 2653845 | 24953 | 184307353 | G/A | 0.175 | 0.168 | 0.775 |
| 472795 | 25435 | 184307835 | G/A | 0.082 | 0.077 | 0.756 |
| 502289 | not mapped | | T/G | 0.003 | 0.000 | 0.172 |
| 507079 | 26847 | 184309247 | G/A | 0.833 | 0.835 | 0.937 |
| 534333 | 27492 | 184309892 | T/C | 0.496 | 0.509 | 0.675 |
| 831242 | 27620 | 184310020 | T/C | 0.728 | 0.776 | 0.064 |
| 536111 | 27678 | 184310078 | C/T | 0.800 | 0.812 | 0.632 |
| 536213 | 27714 | 184310114 | G/A | 0.271 | 0.281 | 0.710 |
| 831245 | 29719 | 184312119 | A/G | 0.020 | 0.012 | 0.314 |
| 639690 | 30234 | 184312634 | T/C | 0.117 | 0.106 | 0.577 |
| 684174 | 31909 | 184314309 | T/C | 0.304 | 0.298 | 0.826 |
| 571761 | 32153 | 184314553 | C/G | 0.406 | 0.425 | 0.525 |
| 1983421 | 33572 | 184315972 | T/C | 0.433 | 0.425 | 0.791 |
| 2314415 | 42164 | 184324564 | T/G | 0.014 | 0.050 | 0.001 |
| 2103062 | 43925 | 184326325 | A/G | 0.328 | 0.361 | 0.256 |
| 6804951 | 45031 | 184327431 | C/T | no AT | no AT | — |
| 1403452 | 45655 | 184328055 | T/C | 0.025 | 0.072 | 0.001 |
| 903950 | 48350 | 184330750 | C/A | 0.577 | 0.594 | 0.556 |
| 2017340 | 48418 | 184330818 | A/G | 0.033 | 0.054 | 0.089 |
| 2001449 | 48563 | 184330963 | G/C | 0.262 | 0.205 | 0.025 |
| 3821522 | 53189 | 184335589 | A/G | 0.500 | 0.480 | 0.508 |
| 1390831 | 56468 | 184338868 | T/G | 0.944 | 0.923 | 0.160 |
| 1353566 | 59358 | 184341758 | C/A | 0.545 | 0.533 | 0.692 |
| 1813856 | 63761 | 184346161 | C/T | 0.040 | 0.041 | 0.933 |
| 2272115 | 65931 | 184348331 | G/A | 0.324 | 0.370 | 0.106 |
| 3732603 | 67040 | 184349440 | G/C | 0.228 | 0.209 | 0.429 |
| 940055 | 69491 | 184351891 | A/C | 0.225 | 0.198 | 0.272 |
| 2314730 | 83308 | 184365708 | A/G | 0.649 | 0.691 | 0.135 |
| 484315 | not mapped | | C/G | 0.256 | 0.234 | 0.404 |
| KIAA0861_3732602 | 126545 | 184408945 | C/T | no AT | no AT | — |
| KIAA0861_2293203 | 137592 | 184419992 | A/T | no AT | no AT | — |
| 7639705 | 147169 | 184429569 | G/T | no AT | no AT | — |

Figure 16:
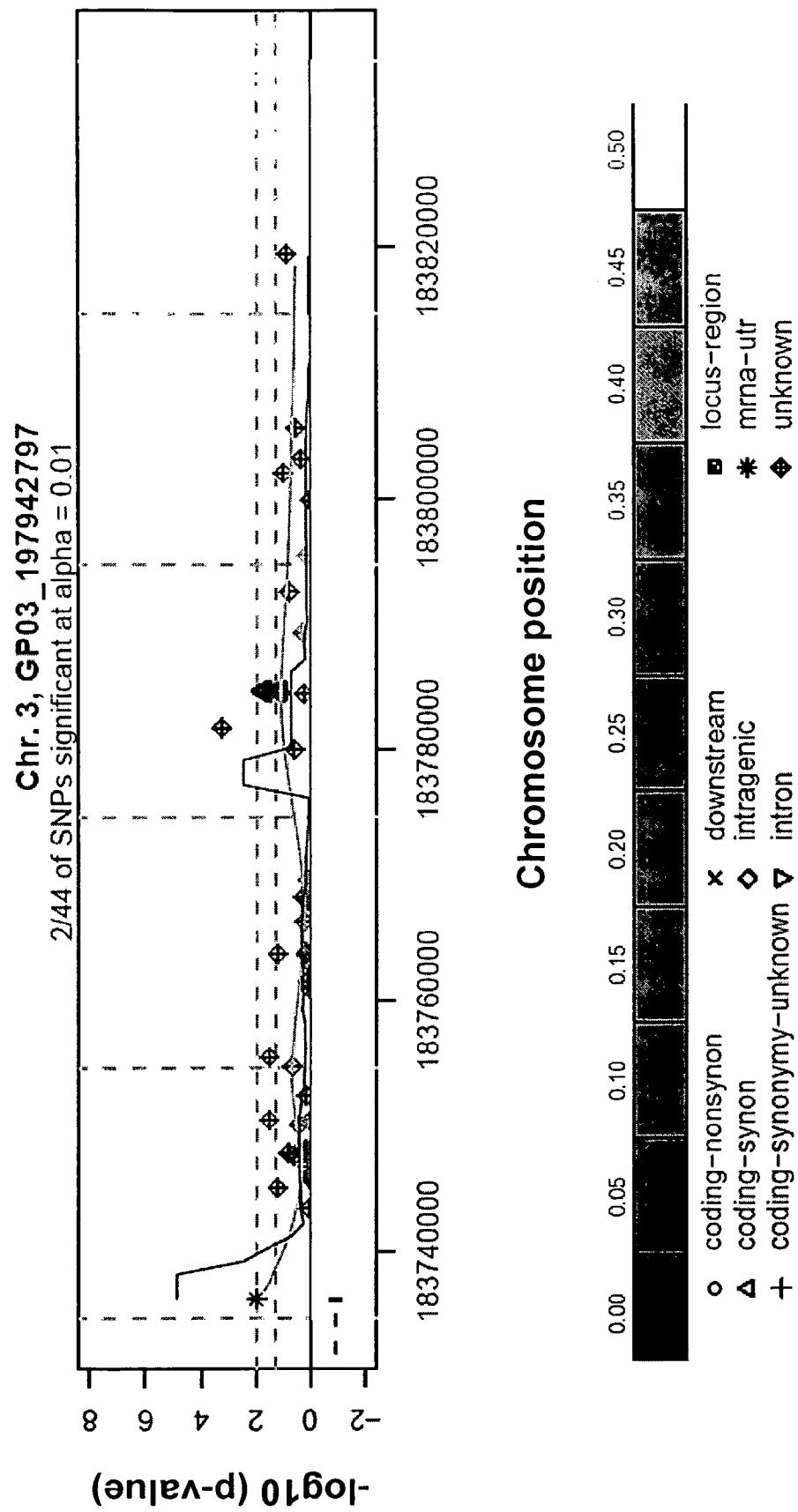
FIG. 16 shows proximal SNPs in the KIAA0861 region in genomic DNA. The position of each SNP on the chromosome is shown on the x-axis and the y-axis provides the negative logarithm of the p-value comparing the estimated allele to that of the control group. Also shown in the figure are exons and introns of the genes in the approximate chromosomal positions. The figure indicates that polymorphic variants associated with breast cancer are in linkage disequilibrium in a region spanning positions 42164-48563 in SEQ ID NO: 3.

FIG. 16 shows the proximal SNPs in and around the KIAA0861 gene for females. As indicated, some of the SNPs were untyped. The position of each SNP on the chromosome is presented on the x-axis. The y-axis gives the negative logarithm (base 10) of the p-value comparing the estimated allele in the case group to that of the control group. The minor allele frequency of the control group for each SNP designated by an X or other symbol on the graphs in FIG. 16 can be determined by consulting Table 23. By proceeding down the Table from top to bottom and across the graphs from left to right the allele frequency associated with each symbol shown can be determined.

To aid the interpretation, multiple lines have been added to the graph. The broken horizontal lines are drawn at two common significance levels, 0.05 and 0.01. The vertical broken lines are drawn every 20 kb to assist in the interpretation of distances between SNPs. Two other lines are drawn to expose linear trends in the association of SNPs to the disease. The light gray line (or generally bottom-most curve) is a nonlinear smoother through the data points on the graph using a local polynomial regression method (W. S. Cleveland, E. Grosse and W. M. Shyu (1992) Local regression models. Chapter 8 of Statistical Models in S eds J. M. Chambers and T. J. Hastie, Wadsworth & Brooks/Cole.). The black line (or generally top-most curve, e.g., see peak in left-most graph just to the left of position 92150000) provides a local test for excess statistical significance to identify regions of association. This was created by use of a 10 kb sliding window with 1 kb step sizes. Within each window, a chi-square goodness of fit test was applied to compare the proportion of SNPs that were significant at a test wise level of 0.01, to the proportion that would be expected by chance alone (0.05 for the methods used here). Resulting p-values that were less than $10^{-8}$ were truncated at that value.

Finally, the gene or genes present in the loci region of the proximal SNPs as annotated by Locus Link (world wide web address ncbi.nlm.nih.gov/LocusLink/) are provided on the graph. The exons and introns of the genes in the covered region are plotted below each graph at the appropriate chromosomal positions. The gene boundary is indicated by the broken horizontal line. The exon positions are shown as thick, unbroken bars. An arrow is place at the 3' end of each gene to show the direction of transcription.

Additional Genotyping

A total of five SNPs, including the incident SNP, were genotyped in the discovery cohort. The discovery cohort is described in Example 1. Four of the SNPs are non-synonomous, coding SNPs. Two of the SNPs (rs2001449 and rs6804951) were found to be significantly associated with breast cancer with a p-value of 0.001 and 0.007, respectively. See Table 26.

The methods used to verify and genotype the five proximal SNPs of Table 26 are the same methods described in Examples 1 and 2 herein. The PCR primers and extend primers used in these assays are provided in Table 24 and Table 25, respectively.

TABLE 24

| dbSNP rs# | Forward PCR primer | SEQ ID NO. | Reverse PCR primer | SEQ ID NO. |
|---|---|---|---|---|
| rs7639705 | ACGTTGGATGTGTCAGAAAGCAAACCTGGC | 703 | ACGTTGGATGTTACAGGCATTGGAGACAGC | 704 |
| rs2293203 | ACGTTGGATGCTGCATAATGGTGGCTTTGG | 705 | ACGTTGGATGTGTGGGTGTTCACTTTGCAG | 706 |
| rs3732602 | ACGTTGGATGCCCTCTTGTCAGGAAGTTCT | 707 | ACGTTGGATGGAGACAGAGTTGAACTCCCG | 708 |
| rs2001449 | ACGTTGGATGAGGAAGAAACTGACGGAAGG | 709 | ACGTTGGATGATGTCAAGTGCACCCACATG | 710 |
| rs6804951 | ACGTTGGATGAAGATACGAATGGAGCCTGG | 711 | ACGTTGGATGGCAATAGGACTCCCTTTACC | 712 |

TABLE 25

| dbSNP rs# | SEQ ID NO. | Extend Primer | Term Mix |
|---|---|---|---|
| rs7639705 | 713 | TGATGCACGTGGAGCAG | CGT |
| rs2293203 | 714 | GCCCCTGGAAAAGGCCC | CGT |
| rs3732602 | 715 | GGAAGATGATGAGACTAAAT | ACG |
| rs2001449 | 716 | CACATGCCTGCTCGCCCCC | ACT |
| rs6804951 | 717 | TCCCTTTACCTTCATGG | ACG |

Table 26, below, shows the case and control allele frequencies along with the p-values for all of the SNPs genotyped. The disease associated allele of column 4 is in bold and the disease associated amino acid of column 5 is also in bold. The chromosome positions provided correspond to NCBI's Build 33. The amino acid change positions provided in column 5 correspond to KIAA0861 polypeptide sequence of FIG. 12.

TABLE 26

Genotpying Results

| Rs number | Position in FIG. 1 | Location within Gene | Alleles (A1/A2) | Amino Acid Change | A2 Case AF | A2 Control AF | p-Value | Odds Ratio |
|---|---|---|---|---|---|---|---|---|
| rs7639705 | 147169 | Exon 7 | G/T | I276L | 0.805 | 0.811 | 0.794 | 1.04 |
| rs2293203 | 137592 | Exon 8 | A/T | Q295L | 0.990 | 0.980 | 0.685 | 1.25 |
| rs3732602 | 126545 | Exon 11 | C/T | S506F | monomorphic | | | |
| rs2001449 | 48563 | Intron 19 | G/C | — | 0.307 | 0.218 | 0.001 | 1.59 |
| rs6804951 | 45031 | Exon 20 | C/T | A819T | 0.044 | 0.085 | 0.007 | 2.02 |

TABLE 27

| dbSNP rs# | Chromosome | Position in FIG. 4 | Chromosome Position | Allele Variants |
|---|---|---|---|---|
| 1894003 | 11 | 174 | 71972974 | T/C |
| 2390981 | 11 | 815 | 71973615 | G/A |
| 1939242 | 11 | 3480 | 71976280 | C/T |
| 1894004 | 11 | 9715 | 71982515 | T/C |
| 645603 | 11 | 14755 | 71987555 | G/A |
| 661290 | 11 | 15912 | 71988712 | A/G |
| 679926 | 11 | 19834 | 71992634 | A/G |
| 567026 | 11 | 19850 | 71992650 | G/A |
| 678193 | 11 | 20171 | 71992971 | T/G |
| 560777 | 11 | 20500 | 71993300 | C/T |
| 676721 | 11 | 20536 | 71993336 | C/T |
| 585228 | 11 | 23187 | 71995987 | C/G |
| 674319 | 11 | 25289 | 71998089 | C/T |
| 675185 | 11 | 25470 | 71998270 | T/G |
| 575871 | 11 | 28720 | 72001520 | A/G |
| 547208 | 11 | 29566 | 72002366 | C/T |
| 2511075 | 11 | 30155 | 72002955 | T/C |
| 642573 | 11 | 30752 | 72003552 | C/G |

Example 7

NUMA1 Proximal SNPs

It has been discovered that a polymorphic variation (rs673478) in the NUMA1/FLJ20625/LOC220074 region is associated with the occurrence of breast cancer (see Examples 1 and 2). Subsequently, SNPs proximal to the incident SNP (rs673478) were identified and allelotyped in breast cancer sample sets and control sample sets as described in Examples 1 and 2. Approximately sixty-three allelic variants located within the NUMA1/FLJ20625/LOC220074 region were identified and allelotyped. The polymorphic variants are set forth in Table 27. The chromosome position provided in column four of Table 27 is based on Genome "Build 33" of NCBI's GenBank.

TABLE 27-continued

| dbSNP rs# | Chromosome | Position in FIG. 4 | Chromosome Position | Allele Variants |
|---|---|---|---|---|
| 671681 | 11 | 32710 | 72005510 | C/T |
| 541022 | 11 | 32954 | 72005754 | A/G |
| 2511076 | 11 | 33725 | 72006525 | G/A |
| 3018308 | 11 | 33842 | 72006642 | T/C |
| 671132 | 11 | 36345 | 72009145 | G/A |
| 552966 | 11 | 38115 | 72010915 | A/C |
| 607446 | 11 | 39150 | 72011950 | C/T |
| 3018302 | 11 | 40840 | 72013640 | T/G |
| 3018301 | 11 | 41969 | 72014769 | A/G |
| 2511114 | 11 | 42045 | 72014845 | C/T |
| 548961 | 11 | 43785 | 72016585 | G/A |
| 575831 | 11 | 44444 | 72017244 | A/G |
| 577435 | 11 | 44579 | 72017379 | T/C |

TABLE 27-continued

| dbSNP rs# | Chromosome | Position in FIG. 4 | Chromosome Position | Allele Variants |
|---|---|---|---|---|
| 495567 | 11 | 45386 | 72018186 | C/T |
| 493065 | 11 | 46827 | 72019627 | A/G |
| 597513 | 11 | 47320 | 72020120 | A/T |
| 598835 | 11 | 47625 | 72020425 | T/C |
| 610004 | 11 | 47837 | 72020637 | T/C |
| 610041 | 11 | 47866 | 72020666 | A/G |
| 673478 | 11 | 49002 | 72021802 | T/C |
| 670802 | 11 | 49566 | 72022366 | T/G |
| 2511116 | 11 | 52058 | 72024858 | C/T |
| NUMA1_SNP1 | 11 | 52249 | 72025049 | A/C |
| 517837 | 11 | 52257 | 72025057 | C/T |
| 615000 | 11 | 52850 | 72025650 | T/G |
| 482013 | 11 | 53860 | 72026660 | C/T |
| NUMA1_SNP2 | 11 | 54052 | 72026852 | T/C |
| 2250866 | 11 | 54411 | 72027211 | T/C |
| 2511078 | 11 | 55098 | 72027898 | G/A |
| 2508858 | 11 | 55303 | 72028103 | C/G |
| 681069 | 11 | 59398 | 72032198 | A/G |
| 595062 | 11 | 59533 | 72032333 | A/G |
| 542752 | 11 | 60542 | 72033342 | A/T |
| 2508856 | 11 | 61541 | 72034341 | C/T |
| 832658 | 11 | 62309 | 72035109 | G/A |
| 3750908 | 11 | 72299 | 72045099 | C/T |
| 3793938 | 11 | 73031 | 72045831 | C/T |
| 2276396 | 11 | 73803 | 72046603 | G/C |
| 1806778 | 11 | 80950 | 72053750 | T/C |
| 4073394 | 11 | 82137 | 72054937 | A/G |
| 471547 | 11 | 96077 | 72068877 | G/T |
| 606136 | 11 | 96470 | 72069270 | A/G |
| 532360 | 11 | 98116 | 72070916 | G/T |
| 703781 | 11 | 98184 | 72070984 | A/C |
| 476753 | 11 | 132952 | 72105752 | A/G |

Assay for Verifying and Allelotyping SNPs

The methods used to verify and allelotype the proximal SNPs of Table 27 are the same methods described in Examples 1 and 2 herein. The PCR primers and extend primers used in these assays are provided in Table 28 and Table 29, respectively.

TABLE 28

| dbSNP rs# | Forward PCR primer | SEQ ID NO. | Reverse PCR primer | SEQ ID NO. |
|---|---|---|---|---|
| 744293 | ACGTTGGATGTCTGCAGACAGTGGCCAATG | 718 | ACGTTGGATGAGGGCCCAGGATCACAATAG | 719 |
| 750789 | ACGTTGGATGTTCATCTGGTAAGTCCCACC | 720 | ACGTTGGATGTGAAACAAGAGAGGCCCTTC | 721 |
| 1939110 | ACGTTGGATGTCTTTAGGTCCAGGATTCCC | 722 | ACGTTGGATGTATAGTCAGCATCGTCCCTG | 723 |
| 2005192 | ACGTTGGATGCCCTCAGAGTTTGGACATAT | 724 | ACGTTGGATGTATCCAAAATGCAGACACAG | 725 |
| SNP00004859 | ACGTTGGATGGTGTTTATCCCAACCCTTCC | 726 | ACGTTGGATGGGAGGAAATACAGCCTGTTC | 727 |
| 744292 | ACGTTGGATGATCCTAGAGGACTGGGAAAG | 728 | ACGTTGGATGCTGCTTCTGTTCCCACAATG | 729 |
| 754490 | ACGTTGGATGAAGGGTGGAGAACTCATGGG | 730 | ACGTTGGATGACCCCTATTTTGAAGCAGGC | 731 |
| 872619 | ACGTTGGATGTTCACACCAAGGTGTTACTG | 732 | ACGTTGGATGCACAATAATGTGTTCAGGGC | 733 |
| 1807014 | ACGTTGGATGCTGGGCAACAAGAGTGAAAC | 734 | ACGTTGGATGGCCCAAAACCACTGAGATTC | 735 |
| 1815753 | ACGTTGGATGTAGAGTGAAGACAGAGCTCC | 736 | ACGTTGGATGATAAACCCAGGCATTCGAGC | 737 |
| 1892893 | ACGTTGGATGTCCTATGAAGATTCATCTGC | 738 | ACGTTGGATGGTCCAGAGTTTTAGACTCAAG | 739 |
| 1939111 | ACGTTGGATGTCCTTAACCTTATTGGTGGC | 740 | ACGTTGGATGGTTGGGTTCAGTAGAAGAGA | 741 |
| 1939112 | ACGTTGGATGAGCCACCAATAAGGTTAAGG | 742 | ACGTTGGATGTGTCTCTCACTTCCTCAACC | 743 |
| 1939113 | ACGTTGGATGAGACACACAAGGCAAGGTTC | 744 | ACGTTGGATGCCAGAGAGGAGTCTGTCTAG | 745 |
| 1939114 | ACGTTGGATGGAAAACATTGGTCCAGGCAG | 746 | ACGTTGGATGCAAGAACCCAGGCATCAATG | 747 |
| 1939115 | ACGTTGGATGGACCACGGAATCCTTTTTCA | 748 | ACGTTGGATGGCTCAAATTCTGTTCTTTAG | 749 |
| 1939116 | ACGTTGGATGACATAGGTAGTCAGGCACTC | 750 | ACGTTGGATGGCAGCTCTTTTTTTCCTACC | 751 |
| 1939117 | ACGTTGGATGGGGAACTTTTCACATTACAC | 752 | ACGTTGGATGGGAGAGTTTGCATTTGGTGATC | 753 |
| 1939118 | ACGTTGGATGATGTTGCTGTATGGTCCTCC | 754 | ACGTTGGATGGAAAACATTGCGCTAGGCAC | 755 |
| 1954769 | ACGTTGGATGTGAGTGACCAAGTTGCTCTG | 756 | ACGTTGGATGTCTACCTTCATGATGTCCCC | 757 |
| 2000537 | ACGTTGGATGGGTCTTTTATGAGGTTTCTCC | 758 | ACGTTGGATGGTTAAACTTACAAATCTAGC | 759 |
| 2011913 | ACGTTGGATGGCTGAGTGTGGATTGCTCTG | 760 | ACGTTGGATGAGTAAACCAACACCCAGAAC | 761 |
| 2015747 | ACGTTGGATGTGAAGCAGGCTTTCCCAATG | 762 | ACGTTGGATGGGTAGTGAAGGGTGGAGAAC | 763 |
| 2105587 | ACGTTGGATGAAGAAATACCAGGCCGGGAG | 764 | ACGTTGGATGCTCAAGTATCCTCCCTTCTC | 765 |

TABLE 28-continued

| dbSNP rs# | Forward PCR primer | SEQ ID NO. | Reverse PCR primer | SEQ ID NO. |
|---|---|---|---|---|
| 2155081 | ACGTTGGATGAGGCAATGCTTCCATTGTTC | 766 | ACGTTGGATGTCATAGCATTTTACCCCTGG | 767 |
| 2186617 | ACGTTGGATGGCTACATATGGATCTTGGTC | 768 | ACGTTGGATGGACCAGCACTAACTCTAAAC | 769 |
| 2508423 | ACGTTGGATGCTCCTCTGTAAAACCAGGAC | 770 | ACGTTGGATGAGAAACTCTCCTAAGCACAC | 771 |
| 2511880 | ACGTTGGATGGTTCCCTGATGGAAAATGCC | 772 | ACGTTGGATGCCAGAATGCCTTATCCACAG | 773 |
| 2511881 | ACGTTGGATGTGACTCTGCTGTGAGATTGG | 774 | ACGTTGGATGACATCGGTTTCACCTCCAAC | 775 |
| 2512990 | ACGTTGGATGAGCCAGCAGAGAAAACAGTC | 776 | ACGTTGGATGGCCACTTACTACCTGTTGTC | 777 |
| 2555537 | ACGTTGGATGGGACATAACCATAGGCCATC | 778 | ACGTTGGATGCATTGACAGCTGTATTGCAC | 779 |
| 3016250 | ACGTTGGATGTTTTTGAGACGGAGTCTCGC | 780 | ACGTTGGATGAGGCAGGAGAATGGCGTGAA | 781 |
| 3016251 | ACGTTGGATGAGCTTGCAGTGAGCCGAGAT | 782 | ACGTTGGATGTTTTTGAGACGGAGTCTCGC | 783 |
| 3016252 | ACGTTGGATGTGGTGAAGAGAAGTCAAAGC | 784 | ACGTTGGATGAGGCTGAATGATTCCCCTTC | 785 |
| 3781614 | ACGTTGGATGTGGTCAGTCAGTTAGCCAGG | 786 | ACGTTGGATGCCCTAATGATGGTAGACTGC | 787 |
| 3809048 | ACGTTGGATGACCACCAAGATAACGACCGC | 788 | ACGTTGGATGAGCCACCTCCTTGTCCAGTG | 789 |
| 4128368 | ACGTTGGATGGGACAATATTTAGTTATGCAC | 790 | ACGTTGGATGTTCAAGGTCATCCCGTTATC | 791 |

TABLE 29

| dbSNP rs# | SEQ ID NO. | Extend Primer | Term Mix |
|---|---|---|---|
| 744293 | 792 | GATGCCCAGTTCCCTGCC | ACG |
| 750789 | 793 | AGAGGCCCTTCCAGGGCT | ACT |
| 1939110 | 794 | CGTCCCTGACCTGGACTTA | ACG |
| 2005192 | 795 | AATGCAGACACAGTTCTGGG | CGT |
| SNP00004859 | 796 | CTGAAAAATAGCTAGTTC | ACG |
| 744292 | 797 | ACTCACCTCTACCCATAAGG | ACT |
| 754490 | 798 | TTGAAGCAGGCTTTCCCA | ACT |
| 872619 | 799 | TGTGTTCAGGGCTTTCTCAT | ACT |
| 1807014 | 800 | GTGTTTTTTTTTCCCCC | ACG |
| 1815753 | 801 | CAGGCATTCGAGCCAGCAAT | ACT |
| 1892893 | 802 | ATGTTTTATTCTTTCACAAAAGT | ACT |
| 1939111 | 803 | GGAGGAGGCAGTAAGGAA | ACT |
| 1939112 | 804 | CTTCCAACTTTTTTCTCTTG | ACT |
| 1939113 | 805 | GTCTAGTCCTCCAAGCC | ACG |
| 1939114 | 806 | ATCAATGGGGTGGTGCA | ACT |
| 1939115 | 807 | TCTGTTCTTTAGAAGGCT | CGT |
| 1939116 | 808 | TGTACCAATATGACAATTTAACC | ACT |
| 1939117 | 809 | CCTGACACATAGTTCATGCTC | ACT |
| 1939118 | 810 | GCTAGGCACAAAATTAAAGAGAT | ACT |
| 1954769 | 811 | TCCCCGCCTTTCCCTCC | CGT |

TABLE 29-continued

| dbSNP rs# | SEQ ID NO. | Extend Primer | Term Mix |
|---|---|---|---|
| 2000537 | 812 | ACAAATCTAGCACCGAAGG | ACT |
| 2011913 | 813 | ATATAAGCAATTCACAAGTAATGT | ACT |
| 2015747 | 814 | AAGGGTGGAGAACTCATGG | ACT |
| 2105587 | 815 | TATCCTCCCTTCTCAGCAAG | ACT |
| 2155081 | 816 | CATTTTACCCCTGGATTATA | ACT |
| 2186617 | 817 | CTCAACCTCAACTCAACT | CGT |
| 2508423 | 818 | TCTCCTAAGCACACTATGTATAT | ACG |
| 2511880 | 819 | AGGATATTAGTCATGCTGGG | ACT |
| 2511881 | 820 | CACCTCCAACACGGTCCCC | CGT |
| 2512990 | 821 | GTTGTCTTCCCAACTCC | ACT |
| 2555537 | 822 | ACTGTGGACATTGGTGT | ACT |
| 3016250 | 823 | GGCGTGAACCCGGGAGG | ACG |
| 3016251 | 824 | CTGTCGCCCAGGCCGGA | ACT |
| 3016252 | 825 | GATTCCCCTTCTTCTAAA | ACT |
| 3781614 | 826 | TAGACTGCAGAGTAGCA | ACT |
| 3809048 | 827 | TGGGCCTACTTCCCTGA | ACT |
| 4128368 | 828 | TTTTCATCACATAGCTCATCT | CGT |

Genetic Analysis of Allelotyping Results

Allelotyping results are shown for cases and controls in Table 30. The allele frequency for the A2 allele is noted in the fifth and sixth columns for breast cancer pools and control pools, respectively, where "AF" is allele frequency. The allele frequency for the A1 allele can be easily calculated by subtracting the A2 allele frequency from 1 (A1 AF=1−A2 AF). For example, the SNP rs1894003 has the following case and control allele frequencies: case A1 (T)=0.192; case A2 (C)=0.808; control A1 (T)=0.115; and control A2 (C)=0.885, where the nucleotide is provided in paranthesis. SNPs with blank allele frequencies were untyped.

Figure 17:
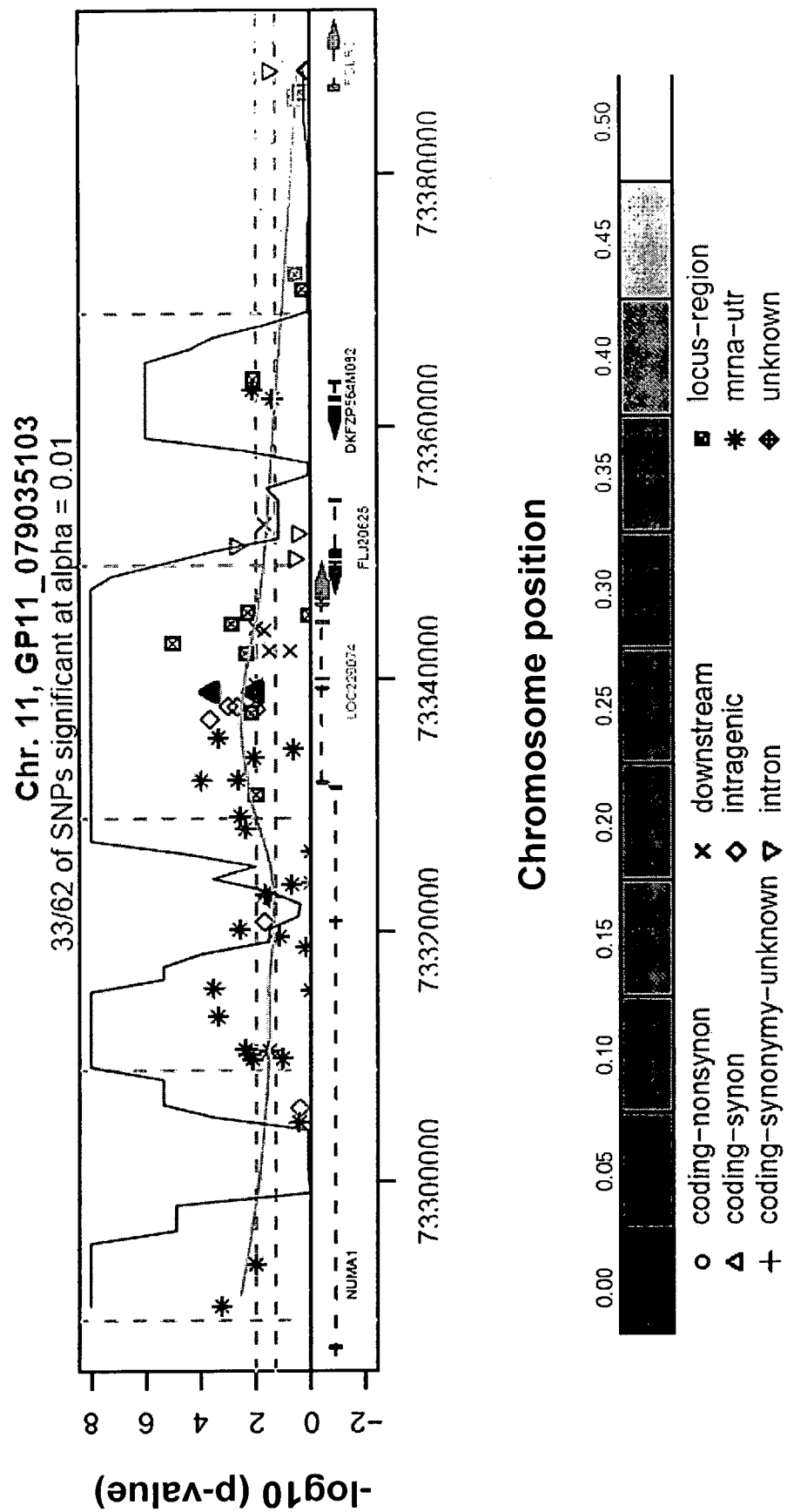
FIG. 17 shows proximal SNPs in the KIAA0861 region in genomic DNA. The position of each SNP on the chromosome is shown on the x-axis and the y-axis provides the negative logarithm of the p-value comparing the estimated allele to that of the control group. Also shown in the figure are exons and introns of the genes in the approximate chromosomal positions. The figure indicates that polymorphic variants associated with breast cancer are in linkage disequilibrium in a region spanning positions 174-32954, 38115-43785, 45386-52058, 52257-54411, 55303-73803 or 96470-98184 in SEQ ID NO: 4.
Figure 18:
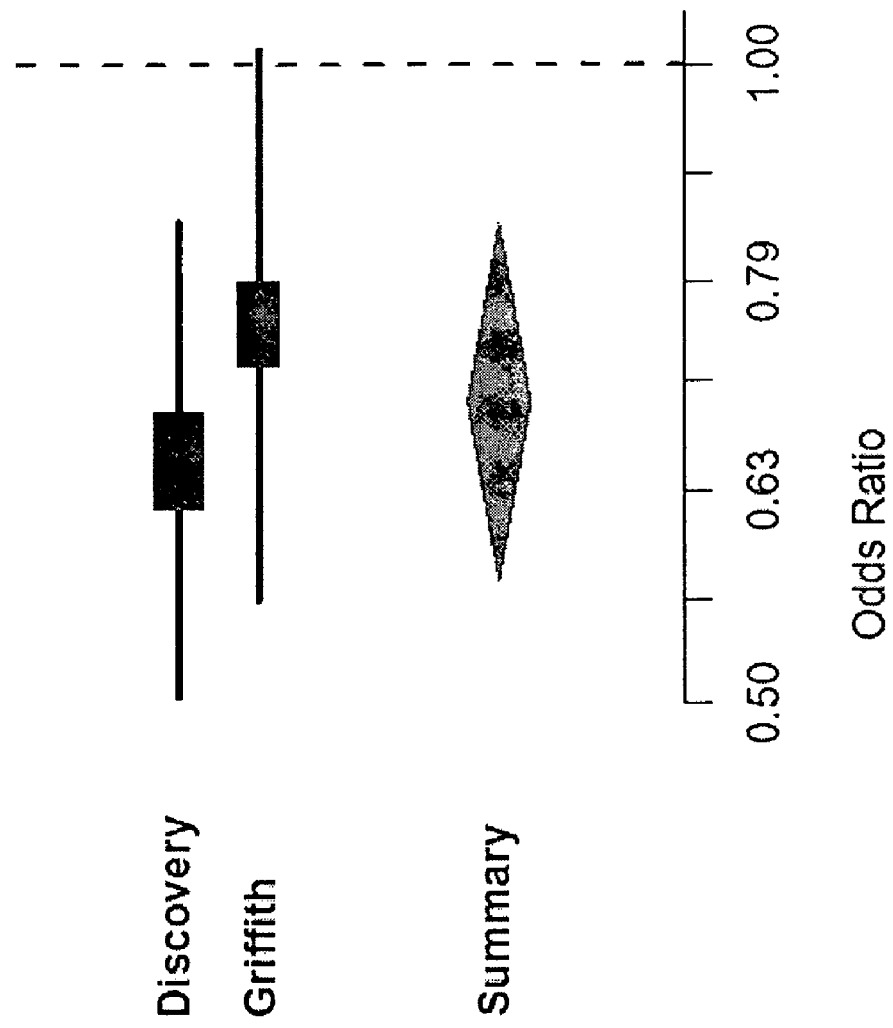
FIG. 18 shows results of an odds-ratio meta analysis for the ICAM region.
Figure 19:
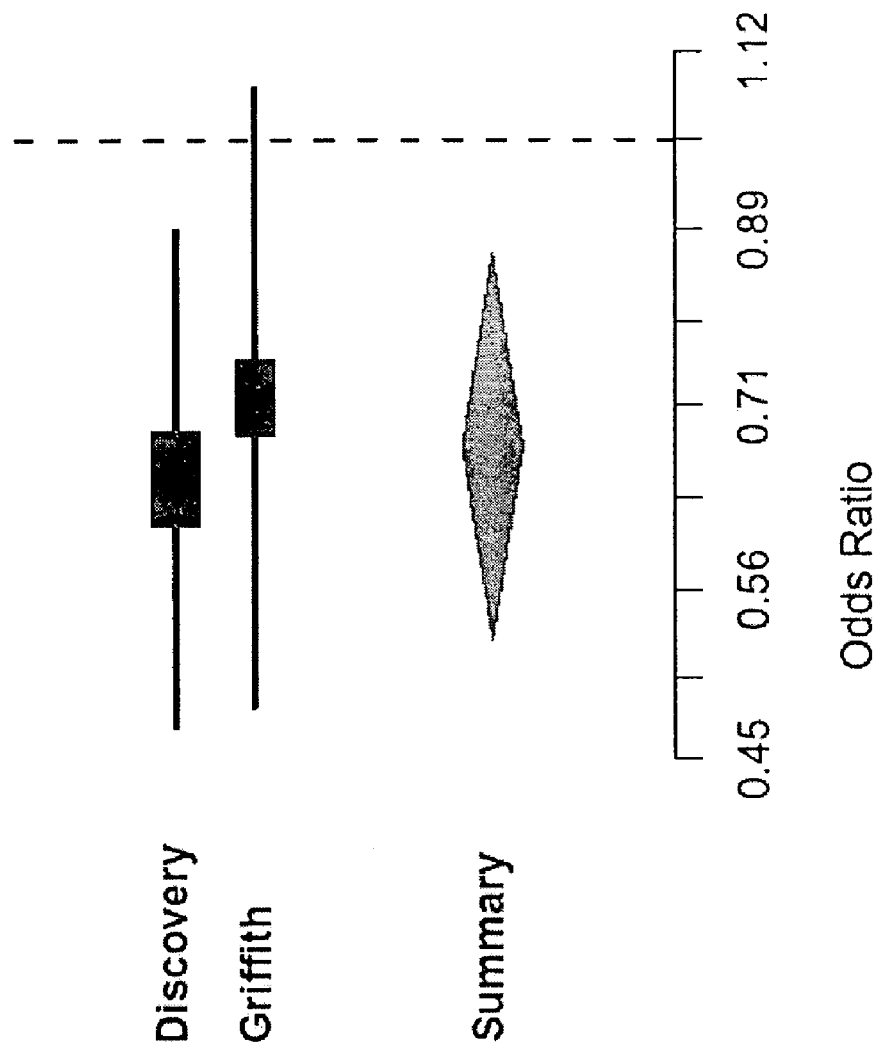
FIG. 19 shows results of an odds-ratio meta analysis for the MAPK10 region.
Figure 20:
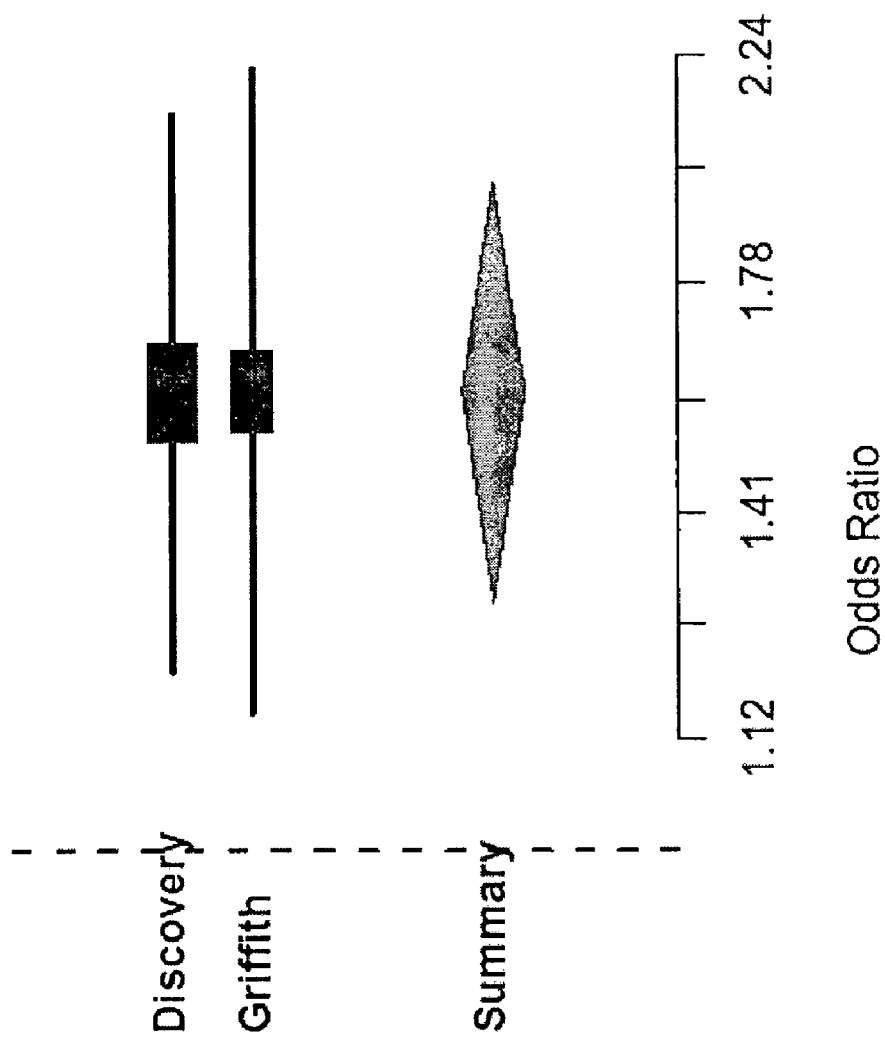
FIG. 20 shows results of an odds-ratio meta analysis for the KIAA0861 region.
Figure 21:
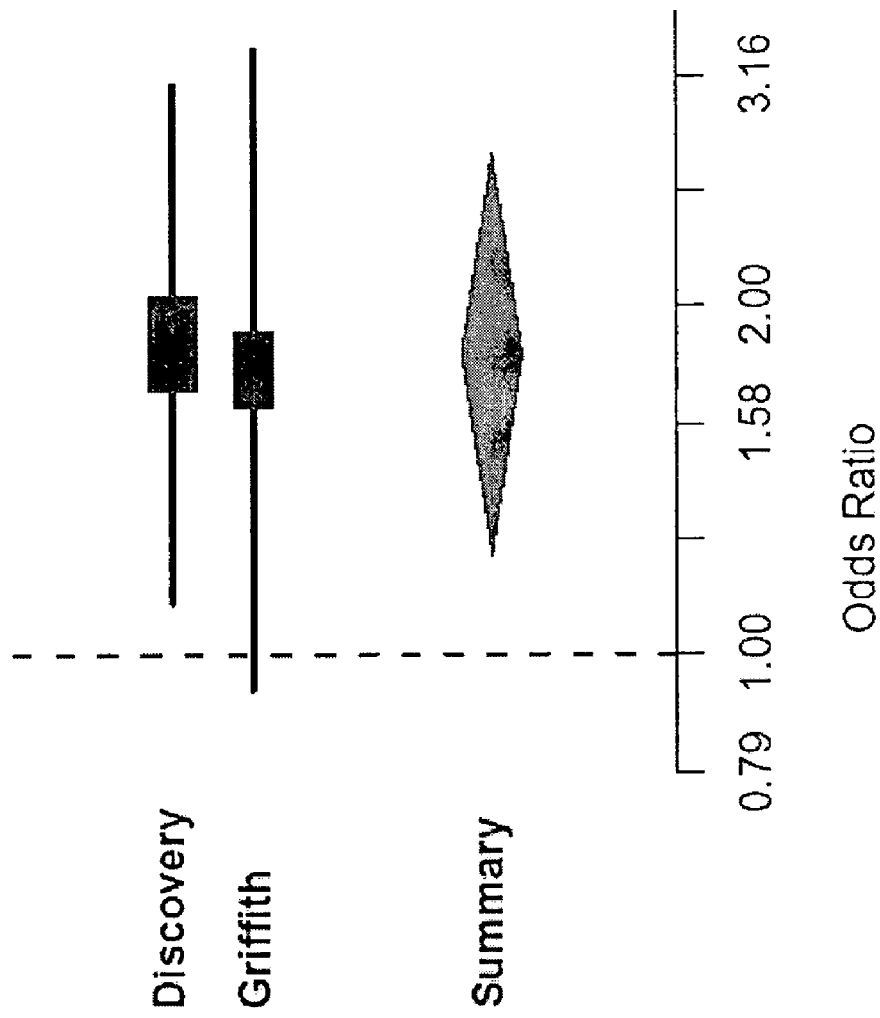
FIG. 21 shows results of an odds-ratio meta analysis for the NUMA1 region.

FIG. 17 shows the proximal SNPs in and around the NUMA1 region for females. The position of each SNP on the chromosome is presented on the x-axis. The y-axis gives the negative logarithm (base 10) of the p-value comparing the estimated allele in the case group to that of the control group. The minor allele frequency of the control group for each SNP designated by an X or other symbol on the graphs in FIG. 17

TABLE 30

| dbSNP rs# | Position in FIG. 4 | Chromosome Position | A1/A2 Allele | A2 Case AF | A2 Control AF | p-Value |
|---|---|---|---|---|---|---|
| 1894003 | 174 | 71972974 | T/C | 0.808 | 0.885 | 0.00061 |
| 2390981 | 815 | 71973615 | G/A | 0.013 | 0.002 | 0.02306 |
| 1939242 | 3480 | 71976280 | C/T | 0.902 | 0.943 | 0.01186 |
| 1894004 | 9715 | 71982515 | T/C | 0.020 | 0.009 | 0.12637 |
| 645603 | 14755 | 71987555 | G/A | 0.029 | 0.021 | 0.37479 |
| 661290 | 15912 | 71988712 | A/G | 0.813 | 0.833 | 0.39013 |
| 679926 | 19834 | 71992634 | A/G | 0.077 | 0.039 | 0.00741 |
| 567026 | 19850 | 71992650 | G/A | 0.059 | 0.038 | 0.09767 |
| 678193 | 20171 | 71992971 | T/G | 0.868 | 0.920 | 0.00597 |
| 560777 | 20500 | 71993300 | C/T | 0.070 | 0.041 | 0.03071 |
| 676721 | 20536 | 71993336 | C/T | 0.901 | 0.947 | 0.00419 |
| 585228 | 23187 | 71995987 | C/G | 0.842 | 0.914 | 0.00043 |
| 674319 | 25289 | 71998089 | C/T | 0.027 | 0.027 | 0.96556 |
| 675185 | 25470 | 71998270 | T/G | 0.763 | 0.853 | 0.00031 |
| 575871 | 28720 | 72001520 | A/G | 0.924 | 0.932 | 0.61199 |
| 547208 | 29566 | 72002366 | C/T | 0.042 | 0.023 | 0.07555 |
| 2511075 | 30155 | 72002955 | T/C | 0.894 | 0.944 | 0.00256 |
| 642573 | 30752 | 72003552 | C/G | 0.047 | 0.022 | 0.02382 |
| 671681 | 32710 | 72005510 | C/T | 0.072 | 0.043 | 0.03643 |
| 541022 | 32954 | 72005754 | A/G | 0.070 | 0.040 | 0.02829 |
| 2511076 | 33725 | 72006525 | G/A | 0.223 | 0.256 | 0.20380 |
| 3018308 | 33842 | 72006642 | T/C | 0.442 | 0.439 | 0.92279 |
| 671132 | 36345 | 72009145 | G/A | 0.970 | 0.971 | 0.96469 |
| 552966 | 38115 | 72010915 | A/C | 0.845 | 0.903 | 0.00393 |
| 607446 | 39150 | 72011950 | C/T | 0.861 | 0.918 | 0.00279 |
| 3018302 | 40840 | 72013640 | T/G | 0.767 | 0.827 | 0.01378 |
| 3018301 | 41969 | 72014769 | A/G | 0.734 | 0.837 | 0.00011 |
| 2511114 | 42045 | 72014845 | C/T | 0.080 | 0.036 | 0.00222 |
| 548961 | 43785 | 72016585 | G/A | 0.852 | 0.905 | 0.00833 |
| 575831 | 44444 | 72017244 | A/G | 0.946 | 0.961 | 0.22995 |
| 577435 | 44579 | 72017379 | T/C | 0.013 | 0.007 | 0.34863 |
| 495567 | 45386 | 72018186 | C/T | 0.891 | 0.951 | 0.00045 |
| 493065 | 46827 | 72019627 | A/G | 0.823 | 0.904 | 0.00022 |
| 597513 | 47320 | 72020120 | A/T | 0.890 | 0.936 | 0.00667 |
| 598835 | 47625 | 72020425 | T/C | 0.074 | 0.038 | 0.00994 |
| 610004 | 47837 | 72020637 | T/C | 0.088 | 0.041 | 0.00209 |
| 610041 | 47866 | 72020666 | A/G | 0.872 | 0.933 | 0.00102 |
| 673478 | 49002 | 72021802 | T/C | 0.173 | 0.094 | 0.00026 |
| 670802 | 49566 | 72022366 | T/G | 0.876 | 0.920 | 0.01646 |
| 2511116 | 52058 | 72024858 | C/T | 0.898 | 0.945 | 0.00437 |
| NUMA1_SNP1 | 52249 | 72025049 | A/C | 0.901 | 0.924 | 0.17421 |
| 517837 | 52257 | 72025057 | C/T | 0.095 | 0.061 | 0.03504 |
| 615000 | 52850 | 72025650 | T/G | 0.812 | 0.916 | 0.00001 |
| 482013 | 53860 | 72026660 | C/T | 0.884 | 0.924 | 0.02391 |
| NUMA1_SNP2 | 54052 | 72026852 | T/C | 0.066 | 0.034 | 0.01392 |
| 2250866 | 54411 | 72027211 | T/C | 0.855 | 0.918 | 0.00132 |
| 2511078 | 55098 | 72027898 | G/A | 0.299 | 0.295 | 0.86946 |
| 2508858 | 55303 | 72028103 | C/G | 0.898 | 0.944 | 0.00509 |
| 681069 | 59398 | 72032198 | A/G | 0.835 | 0.878 | 0.04069 |
| 595062 | 59533 | 72032333 | A/G | 0.925 | 0.942 | 0.25198 |
| 542752 | 60542 | 72033342 | A/T | 0.853 | 0.915 | 0.00192 |
| 2508856 | 61541 | 72034341 | C/T | 0.074 | 0.060 | 0.33745 |
| 832658 | 62309 | 72035109 | G/A | 0.047 | 0.023 | 0.02994 |
| 3750908 | 72299 | 72045099 | C/T | 0.912 | 0.944 | 0.04342 |
| 3793938 | 73031 | 72045831 | C/T | 0.084 | 0.045 | 0.00763 |
| 2276396 | 73803 | 72046603 | G/C | 0.892 | 0.937 | 0.00799 |
| 1806778 | 80950 | 72053750 | T/C | 0.041 | 0.034 | 0.50886 |
| 4073394 | 82137 | 72054937 | A/G | 0.547 | 0.579 | 0.28705 |
| 471547 | 96077 | 72068877 | G/T | 0.490 | 0.522 | 0.28304 |
| 606136 | 96470 | 72069270 | A/G | 0.444 | 0.468 | 0.43474 |
| 532360 | 98116 | 72070916 | G/T | 0.043 | 0.021 | 0.03475 |
| 703781 | 98184 | 72070984 | A/C | 0.078 | 0.080 | 0.89053 |
| 476753 | 132952 | 72105752 | A/G | 0.922 | 0.936 | 0.39563 | can be determined by consulting Table 30. By proceeding down the Table from top to bottom and across the graphs from left to right the allele frequency associated with each symbol shown can be determined.

To aid the interpretation, multiple lines have been added to the graph. The broken horizontal lines are drawn at two common significance levels, 0.05 and 0.01. The vertical broken lines are drawn every 20 kb to assist in the interpretation of distances between SNPs. Two other lines are drawn to expose linear trends in the association of SNPs to the disease. The light gray line (or generally bottom-most curve) is a nonlinear smoother through the data points on the graph using a local polynomial regression method (W. S. Cleveland, E. Grosse and W. M. Shyu (1992) Local regression models. Chapter 8 of Statistical Models in S eds J. M. Chambers and T. J. Hastie, Wadsworth & Brooks/Cole.). The black line (or generally top-most curve, e.g., see peak in left-most graph just to the left of position 92150000) provides a local test for excess statistical significance to identify regions of association. This was created by use of a 10 kb sliding window with 1 kb step sizes. Within each window, a chi-square goodness of fit test was applied to compare the proportion of SNPs that were significant at a test wise level of 0.01, to the proportion that would be expected by chance alone (0.05 for the methods used here). Resulting p-values that were less than $10^{-8}$ were truncated at that value.

Finally, the gene or genes present in the loci region of the proximal SNPs as annotated by Locus Link (world wide web address ncbi.nlm.nih.gov/LocusLink/) are provided on the graph. The exons and introns of the genes in the covered region are plotted below each graph at the appropriate chromosomal positions. The gene boundary is indicated by the broken horizontal line. The exon positions are shown as thick, unbroken bars. An arrow is place at the 3' end of each gene to show the direction of transcription.

Example 8

Meta Analysis of Incident SNPs

Meta-analysis was performed of five of the incident SNPs disclosed in Table 3 (ICAM region (ICAM_SNP), MAPK10 (rs1541998), KIAA0861 (rs2001449), NUMA1 region (rs673478) and GALE region (rs4237)) based on genotype results provided in Table 6B. FIGS. 18-21 depict odds ratios for the discovery samples and replication samples (see Example 3) individually, and the combined meta analysis odds ratio for the named SNP. The boxes are centered over the odds ratio for each sample, with the size of the box correlated to the contribution of each sample to the combined meta analysis odds ratio. The lines extending from each box are the 95% confidence interval values. The diamond is centered over the combined meta analysis odds ratio with the ends of the diamond depicting the 95% confidence interval values. The meta-analysis further illustrates the strong association each of the incident SNPs has with breast cancer across multiple case and control samples.

The subjects available for discovery from Germany included 272 cases and 276 controls. The subjects available for replication from Australia included 190 breast cancer cases and 190 controls. Meta analyses, combining the results of the German discovery sample and the Australian replication sample, were carried out using a random effects (DerSimonian-Laird) procedure.

Example 9

Description of Development of Predictive Breast Cancer Models

The five SNPs reported in Example 3 were identified as being significantly associated with breast cancer according to the replication analysis discussed therein. These five SNPs are a subset of the panel of SNPs associated with breast cancer in the German chort referenced in Example 1 and reported in provisional patent application No. 60/429,136 filed Nov. 25, 2002 and provisional patent application No. 60/490,234 filed Jul. 24, 2003, respectively.

The clinical importance of these SNPs was estimated by combining them into a single logistic regression model. The coefficients of the model were used to estimate penetrance, relative risk and odds ratio values for estimating a subject's risk of having or developing breast cancer according to the subject's genotype. Penetrance is a probability that an individual has or will have breast cancer given their genotype (e.g., a value of 0.01 in the tables is equal to a 1% chance of having or developing breast cancer). The relative risk of breast cancer is based upon penetrance values, and is expressed in two forms. One form, noted as RR in the tables below, is expressed as a risk with respect to the lowest risk group (e.g., the most protected group being the 00000 genotype listed in Table 33). The other form is expressed as a risk with respect to a population average risk of breast cancer, which is noted as RR(Pop) in Table 35 below. Both of these expressions of relative risk are useful to a clinician for assessing risk of breast cancer in an individual and targeting appropriate detection, prevention and/or treatment regimens to the subject. Both expressions of relative risk also are useful to an insurance company to assess population risks of breast cancer (e.g., for developing actuarial tables), where individual genotypes often are provided to the company on an anonymous basis. Odds ratios are the odds one group has or will develop breast cancer with respect to another group, the other group often being the most protective group or the group having a population average risk of breast cancer. Relative risk often is a more reliable assessment of risk in comparison to an odds ratio when the disease or condition at issue is more prevalent.

To fit the single logistic model, all cases and controls from the German and Australian samples were used (see Examples 1 and 3, respectively). Controls were coded as 0 and cases were coded as 1. Based on the genotype penetrance estimates of each SNP (Table 31), GP01.025495354 (rs4237), GP03.197942797 (rs2001449), GP11.079035103 (rs673478) were modeled as additive by coding the genotypes 0, 1, or 2 for the low risk homozygote, the heterozygote, or high risk homozygote, respectively. The SNP FCH.0994 (ICAM_SNP1) was modeled as recessive coding the genotypes 0, 0, or 2 for the low risk homozygote, heterozygote, or high risk homozygote, respectively. The SNP GP04.091348915 (rs1541998) was modeled as dominant coding the genotypes 0, 2, or 2 for the low risk homozygote, the heterozygote, or high risk homozygote, respectively. Table 31 summarizes this analysis.

TABLE 31

| SNP: Genotype | N | Case (N = 254) | Control (N = 268) | P(D\|G) (%) | P-value |
|---|---|---|---|---|---|
| ICAM_SNP1: | | | | | |
| CC | 497 | 45% (103) | 32% (85) | 4.140 | 0.006210 |
| CT | | 42% (98) | 47% (126) | 2.700 | |
| TT | | 13% (30) | 21% (13) | 1.910 | |
| rs4237: | | | | | |
| AA | 494 | 34% (79) | 29% (75) | 3.550 | 0.186000 |
| AG | | 49% (113) | 48% (126) | 3.040 | |
| GG | | 17% (40) | 23% (61) | 2.240 | |
| rs2001449: | | | | | |
| GG | 508 | 46% (112) | 60% (158) | 2.280 | 0.002930 |
| GC | | 48% (117) | 36% (94) | 3.940 | |
| CC | | 7% (17) | 4% (10) | 5.300 | |
| rs673478: | | | | | |
| TT | 509 | 84% (206) | 91% (240) | 2.800 | 0.040700 |
| TC | | 14% (35) | 9% (25) | 4.490 | |
| CC | | 1% (3) | 0% (0) | 100.00 | |
| rs1541998: | | | | | |
| CC | 493 | 5% (12) | 4% (10) | 3.710 | 0.012100 |
| CT | | 36% (87) | 24% (61) | 4.370 | |
| TT | | 59% (143) | 72% (180) | 2.490 | |

Based on this coding, there are a total of 108 unique genotype codes from the 243 unique five SNP genotypes. The relationship between the five SNP genotypes and the case-control status was fit using logistic regression. Many models were fit and compared including the five SNPs and all possible interaction among SNPs and study center. Only statistically significant terms from this complete model were included in the final model, shown in Table 32.

TABLE 32

| | Estimate | Std. Error | z value | Pr(>\|z\|) |
|---|---|---|---|---|
| (Intercept) | −1.34446 | 0.25972 | −5.177 | 2.26e−07 |
| FCH.0994 | 0.77607 | 0.19835 | 3.913 | 9.13e−05 |
| 4237 | 0.54525 | 0.17666 | 3.086 | 0.002025 |
| 2001449 | 0.60383 | 0.28487 | 2.120 | 0.034033 |
| 1541998 | 0.22051 | 0.07849 | 2.809 | 0.004963 |
| 673478 | 0.59961 | 0.21737 | 2.758 | 0.005807 |
| FCH.0994c: 4237 | −0.52636 | 0.14516 | −3.626 | 0.000288 |
| FCH.0994c: 2001449 | −0.35613 | 0.24503 | −1.453 | 0.146113 |

TABLE 32-continued

| | Estimate | Std. Error | z value | Pr(>\|z\|) |
|---|---|---|---|---|
| 4237c: 2001449 | −0.15685 | 0.20191 | −0.777 | 0.437257 |
| FCH.0994c: 4237c2001449 | 0.41305 | 0.18391 | 2.246 | 0.024705 |

Null deviance: 1136.7 on 820 degrees of freedom
Residual devianace: 1069 on 811 degrees of freedom
AIC: 1089.6

The penetrance was calculated for each of the 108 unique genotype codes using this model and an assumed disease prevalence of 0.03 (prev), the cumulative incidence for the age range of the sample in question. This was calculated from the logistic model as follows:

penetrance=exp($\hat{y}$+adj)/(1+exp($\hat{y}$+adj))

where $\hat{y}$=1/(1+exp(−1.344+0.776*A+0.545*B+0.604*C+ 0.221*D+0.600*E−0.526*A*B−0.356*A*C− 0.157*B*C+0.413*A*B*C))

and adj=ln(prev/(1−prev)*freq(case)/(1−freq(case)).

Here A, B, C, D, and E refer to the genotype codes for the SNPs FCH.0994, 4237, 2001449, 1541998, and 673478, respectively.

Table 33 summarizes statistics of interest for each genotype code. "Geno" shows each genotype code with the five integer codes formatted as an integer string. "N Case" and "N Control" is the number of cases and controls with the specified code, respectively. "Frequency" is the expected percent of individuals in the population having that code calculated as the average of the case and control frequencies weighted by the probability of disease in this sample (0.03). "OR" is the odds ratio comparing the odds of the specified code to the odds of the most protective code (00000) using the parameter estimates from the logistic regression model. "OR (Frq)" is an odds ratio estimated using the frequency of cases and control with the specified genotype code and the most protective code. "RR" is the relative risk comparing the probability of disease of the specified code to the probability of disease of the most protective code. "Penetrance" is the probability of disease given the genotype code, followed by "Lower" and "Upper" which give the 95% confidence interval for the penetrance. As can be seen by the ratios for OR and RR, the 00000 genotype was the most protective against breast cancer occurrence.

TABLE 33

| | | | | | | | | Confidence Interval | |
|---|---|---|---|---|---|---|---|---|---|
| Geno | N Case | N Control | Frequency | OR | OR (Frq) | RR | Penetrance | Lower | Upper |
| 00000 | 6 | 26 | 5.94% | 1.00 | 1.00 | 1.00 | 0.010 | 0.007 | 0.014 |
| 00001 | 0 | 3 | 0.68% | 1.75 | 0.00 | 1.74 | 0.017 | 0.011 | 0.029 |
| 00002 | 0 | 0 | 0.00% | 3.08 | | 3.01 | 0.030 | 0.013 | 0.069 |
| 00020 | 3 | 9 | 2.06% | 1.61 | 1.44 | 1.60 | 0.016 | 0.011 | 0.023 |
| 00021 | 0 | 3 | 0.68% | 2.83 | 0.00 | 2.78 | 0.028 | 0.017 | 0.047 |
| 00022 | 0 | 0 | 0.00% | 4.97 | | 4.78 | 0.048 | 0.021 | 0.108 |
| 00100 | 9 | 20 | 4.60% | 1.67 | 1.95 | 1.66 | 0.017 | 0.012 | 0.023 |
| 00101 | 2 | 1 | 0.24% | 2.93 | 8.67 | 2.87 | 0.029 | 0.018 | 0.047 |
| 00102 | 0 | 0 | 0.00% | 5.13 | | 4.93 | 0.050 | 0.022 | 0.110 |
| 00120 | 7 | 6 | 1.41% | 2.69 | 5.06 | 2.65 | 0.027 | 0.018 | 0.038 |
| 00121 | 0 | 0 | 0.00% | 4.73 | | 4.56 | 0.046 | 0.028 | 0.075 |
| 00122 | 0 | 0 | 0.00% | 8.29 | | 7.72 | 0.078 | 0.034 | 0.168 |
| 00200 | 1 | 4 | 0.91% | 2.78 | 1.08 | 2.74 | 0.027 | 0.018 | 0.042 |

TABLE 33-continued

| Geno | N Case | N Control | Frequency | OR | OR (Frq) | RR | Penetrance | Confidence Interval Lower | Upper |
|---|---|---|---|---|---|---|---|---|---|
| 00201 | 0 | 0 | 0.00% | 4.88 | | 4.70 | 0.047 | 0.027 | 0.082 |
| 00202 | 0 | 0 | 0.00% | 8.57 | | 7.96 | 0.080 | 0.034 | 0.178 |
| 00220 | 1 | 1 | 0.23% | 4.50 | 4.33 | 4.34 | 0.044 | 0.027 | 0.070 |
| 00221 | 1 | 0 | 0.01% | 7.89 | | 7.38 | 0.074 | 0.041 | 0.129 |
| 00222 | 0 | 0 | 0.00% | 13.83 | | 12.25 | 0.123 | 0.052 | 0.263 |
| 01000 | 24 | 47 | 10.84% | 1.26 | 2.21 | 1.26 | 0.013 | 0.010 | 0.016 |
| 01001 | 3 | 1 | 0.25% | 2.21 | 13.00 | 2.18 | 0.022 | 0.014 | 0.034 |
| 01002 | 0 | 0 | 0.00% | 3.87 | | 3.77 | 0.038 | 0.017 | 0.083 |
| 01020 | 18 | 22 | 5.12% | 2.03 | 3.55 | 2.01 | 0.020 | 0.015 | 0.027 |
| 01021 | 4 | 4 | 0.94% | 3.57 | 4.33 | 3.48 | 0.035 | 0.022 | 0.055 |
| 01022 | 0 | 0 | 0.00% | 6.26 | | 5.94 | 0.060 | 0.027 | 0.129 |
| 01100 | 21 | 33 | 7.64% | 2.10 | 2.76 | 2.08 | 0.021 | 0.017 | 0.026 |
| 01101 | 2 | 4 | 0.92% | 3.69 | 2.17 | 3.59 | 0.036 | 0.024 | 0.055 |
| 01102 | 0 | 0 | 0.00% | 6.47 | | 6.13 | 0.062 | 0.028 | 0.130 |
| 01120 | 15 | 6 | 1.47% | 3.39 | 10.83 | 3.31 | 0.033 | 0.025 | 0.045 |
| 01121 | 0 | 0 | 0.00% | 5.95 | | 5.67 | 0.057 | 0.036 | 0.089 |
| 01122 | 0 | 0 | 0.00% | 10.44 | | 9.54 | 0.096 | 0.044 | 0.198 |
| 01200 | 5 | 4 | 0.94% | 3.51 | 5.42 | 3.42 | 0.034 | 0.023 | 0.050 |
| 01201 | 0 | 1 | 0.23% | 6.15 | 0.00 | 5.85 | 0.059 | 0.035 | 0.097 |
| 01202 | 0 | 0 | 0.00% | 10.79 | | 9.82 | 0.099 | 0.044 | 0.209 |
| 01220 | 1 | 0 | 0.01% | 5.66 | | 5.41 | 0.054 | 0.035 | 0.083 |
| 01221 | 0 | 0 | 0.00% | 9.93 | | 9.12 | 0.092 | 0.054 | 0.152 |
| 01222 | 0 | 0 | 0.00% | 17.42 | | 14.95 | 0.150 | 0.067 | 0.304 |
| 02000 | 22 | 39 | 9.01% | 1.59 | 2.44 | 1.58 | 0.016 | 0.012 | 0.021 |
| 02001 | 2 | 1 | 0.24% | 2.78 | 8.67 | 2.73 | 0.027 | 0.017 | 0.043 |
| 02002 | 1 | 0 | 0.01% | 4.88 | | 4.70 | 0.047 | 0.021 | 0.103 |
| 02020 | 16 | 10 | 2.39% | 2.56 | 6.93 | 2.52 | 0.025 | 0.018 | 0.035 |
| 02021 | 2 | 2 | 0.47% | 4.49 | 4.33 | 4.34 | 0.044 | 0.027 | 0.070 |
| 02022 | 2 | 0 | 0.02% | 7.88 | | 7.37 | 0.074 | 0.033 | 0.158 |
| 02100 | 21 | 18 | 4.24% | 2.65 | 5.06 | 2.60 | 0.026 | 0.020 | 0.035 |
| 02101 | 5 | 3 | 0.72% | 4.64 | 7.22 | 4.48 | 0.045 | 0.029 | 0.070 |
| 02102 | 0 | 0 | 0.00% | 8.14 | | 7.60 | 0.076 | 0.035 | 0.160 |
| 02120 | 11 | 8 | 1.90% | 4.28 | 5.96 | 4.14 | 0.042 | 0.030 | 0.058 |
| 02121 | 1 | 0 | 0.01% | 7.50 | | 7.04 | 0.071 | 0.044 | 0.112 |
| 02122 | 0 | 0 | 0.00% | 13.15 | | 11.72 | 0.118 | 0.054 | 0.239 |
| 02200 | 4 | 4 | 0.94% | 4.42 | 4.33 | 4.27 | 0.043 | 0.028 | 0.065 |
| 02201 | 3 | 1 | 0.25% | 7.75 | 13.00 | 7.26 | 0.073 | 0.043 | 0.121 |
| 02202 | 0 | 0 | 0.00% | 13.59 | | 12.06 | 0.121 | 0.053 | 0.252 |
| 02220 | 2 | 1 | 0.24% | 7.13 | 8.67 | 6.72 | 0.068 | 0.043 | 0.106 |
| 02221 | 0 | 0 | 0.00% | 12.51 | | 11.21 | 0.113 | 0.065 | 0.189 |
| 02222 | 0 | 0 | 0.00% | 21.94 | | 18.13 | 0.182 | 0.082 | 0.358 |
| 20000 | 9 | 6 | 1.43% | 1.58 | 6.50 | 1.57 | 0.016 | 0.011 | 0.023 |
| 20001 | 0 | 0 | 0.00% | 2.76 | | 2.72 | 0.027 | 0.016 | 0.045 |
| 20002 | 0 | 0 | 0.00% | 4.85 | | 4.67 | 0.047 | 0.020 | 0.105 |
| 20020 | 8 | 4 | 0.97% | 2.54 | 8.67 | 2.51 | 0.025 | 0.017 | 0.037 |
| 20021 | 0 | 0 | 0.00% | 4.46 | | 4.31 | 0.043 | 0.026 | 0.072 |
| 20022 | 0 | 0 | 0.00% | 7.83 | | 7.33 | 0.074 | 0.032 | 0.161 |
| 20100 | 5 | 6 | 1.40% | 2.63 | 3.61 | 2.59 | 0.026 | 0.018 | 0.037 |
| 20101 | 4 | 1 | 0.26% | 4.61 | 17.33 | 4.45 | 0.045 | 0.027 | 0.072 |
| 20102 | 0 | 0 | 0.00% | 8.09 | | 7.55 | 0.076 | 0.033 | 0.163 |
| 20120 | 4 | 1 | 0.26% | 4.25 | 17.33 | 4.11 | 0.041 | 0.028 | 0.060 |
| 20121 | 1 | 0 | 0.01% | 7.45 | | 6.99 | 0.070 | 0.042 | 0.115 |
| 20122 | 0 | 0 | 0.00% | 13.06 | | 11.65 | 0.117 | 0.052 | 0.242 |
| 20200 | 0 | 1 | 0.23% | 4.39 | 0.00 | 4.24 | 0.043 | 0.027 | 0.066 |
| 20201 | 1 | 0 | 0.01% | 7.70 | | 7.21 | 0.072 | 0.041 | 0.124 |
| 20202 | 0 | 0 | 0.00% | 13.50 | | 11.99 | 0.121 | 0.052 | 0.255 |
| 20220 | 0 | 0 | 0.00% | 7.09 | | 6.68 | 0.067 | 0.041 | 0.108 |
| 20221 | 0 | 0 | 0.00% | 12.43 | | 11.15 | 0.112 | 0.063 | 0.192 |
| 20222 | 0 | 0 | 0.00% | 21.80 | | 18.03 | 0.181 | 0.080 | 0.361 |
| 21000 | 22 | 25 | 5.83% | 1.99 | 3.81 | 1.97 | 0.020 | 0.015 | 0.026 |
| 21001 | 3 | 4 | 0.93% | 3.48 | 3.25 | 3.40 | 0.034 | 0.022 | 0.053 |
| 21002 | 1 | 0 | 0.01% | 6.11 | | 5.81 | 0.058 | 0.026 | 0.125 |
| 21020 | 11 | 14 | 3.26% | 3.21 | 3.40 | 3.14 | 0.032 | 0.023 | 0.043 |
| 21021 | 1 | 2 | 0.46% | 5.62 | 2.17 | 5.37 | 0.054 | 0.034 | 0.085 |
| 21022 | 0 | 0 | 0.00% | 9.86 | | 9.05 | 0.091 | 0.041 | 0.190 |
| 21100 | 26 | 24 | 5.64% | 3.31 | 4.69 | 3.24 | 0.033 | 0.025 | 0.042 |
| 21101 | 1 | 2 | 0.46% | 5.81 | 2.17 | 5.54 | 0.056 | 0.036 | 0.085 |
| 21102 | 1 | 0 | 0.01% | 10.19 | | 9.33 | 0.094 | 0.043 | 0.191 |
| 21120 | 16 | 6 | 1.48% | 5.35 | 11.56 | 5.12 | 0.051 | 0.037 | 0.071 |
| 21121 | 4 | 0 | 0.03% | 9.38 | | 8.65 | 0.087 | 0.055 | 0.135 |
| 21122 | 0 | 0 | 0.00% | 16.45 | | 14.24 | 0.143 | 0.067 | 0.281 |
| 21200 | 3 | 1 | 0.25% | 5.53 | 13.00 | 5.29 | 0.053 | 0.036 | 0.078 |
| 21201 | 3 | 0 | 0.02% | 9.69 | | 8.92 | 0.090 | 0.054 | 0.146 |
| 21202 | 0 | 0 | 0.00% | 17.00 | | 14.65 | 0.147 | 0.067 | 0.295 |
| 21220 | 2 | 2 | 0.47% | 8.93 | 4.33 | 8.27 | 0.083 | 0.053 | 0.127 |

TABLE 33-continued

| Geno | N Case | N Control | Frequency | OR | OR (Frq) | RR | Penetrance | Confidence Interval Lower | Upper |
|---|---|---|---|---|---|---|---|---|---|
| 21221 | 1 | 0 | 0.01% | 15.65 |  | 13.65 | 0.137 | 0.081 | 0.223 |
| 21222 | 0 | 0 | 0.00% | 27.46 |  | 21.69 | 0.218 | 0.101 | 0.409 |
| 22000 | 13 | 23 | 5.31% | 2.50 | 2.45 | 2.46 | 0.025 | 0.018 | 0.034 |
| 22001 | 4 | 1 | 0.26% | 4.39 | 17.33 | 4.24 | 0.043 | 0.027 | 0.068 |
| 22002 | 0 | 1 | 0.23% | 7.69 | 0.00 | 7.21 | 0.072 | 0.032 | 0.154 |
| 22020 | 3 | 10 | 2.29% | 4.04 | 1.30 | 3.92 | 0.039 | 0.027 | 0.056 |
| 22021 | 1 | 0 | 0.01% | 7.08 |  | 6.67 | 0.067 | 0.041 | 0.107 |
| 22022 | 0 | 0 | 0.00% | 12.42 |  | 11.14 | 0.112 | 0.051 | 0.230 |
| 22100 | 15 | 5 | 1.25% | 4.17 | 13.00 | 4.04 | 0.041 | 0.030 | 0.055 |
| 22101 | 1 | 0 | 0.01% | 7.32 |  | 6.88 | 0.069 | 0.044 | 0.107 |
| 22102 | 0 | 0 | 0.00% | 12.83 |  | 11.47 | 0.115 | 0.053 | 0.232 |
| 22120 | 3 | 5 | 1.16% | 6.74 | 2.60 | 6.37 | 0.064 | 0.045 | 0.091 |
| 22121 | 3 | 1 | 0.25% | 11.82 | 13.00 | 10.66 | 0.107 | 0.066 | 0.168 |
| 22122 | 0 | 0 | 0.00% | 20.72 |  | 17.30 | 0.174 | 0.081 | 0.333 |
| 22200 | 4 | 0 | 0.03% | 6.96 |  | 6.57 | 0.066 | 0.043 | 0.100 |
| 22201 | 0 | 0 | 0.00% | 12.21 |  | 10.97 | 0.110 | 0.065 | 0.181 |
| 22202 | 0 | 0 | 0.00% | 21.42 |  | 17.77 | 0.179 | 0.081 | 0.348 |
| 22220 | 4 | 1 | 0.26% | 11.24 | 17.33 | 10.19 | 0.102 | 0.064 | 0.160 |
| 22221 | 0 | 0 | 0.00% | 19.72 |  | 16.60 | 0.167 | 0.097 | 0.271 |
| 22222 | 0 | 0 | 0.00% | 34.58 |  | 25.86 | 0.260 | 0.122 | 0.470 |

To simplify the interpretation of genotype risk, the 243 unique genotypes were divided into five risk classes on the basis of each estimated penetrance. The levels selected for risk class definitions and the resulting assignment of genotypes into five risk classes is shown in Table 34. The frequency percent of each genotype combination is given in parentheses.

TABLE 34

| Class 1 (0, 0.013] | Class 2 (0.013, 0.025] | Class 3 (0.025, 0.042] | Class 4 (0.042, 0.1] | Class 5 (0.1, 1) |
|---|---|---|---|---|
| 00000 (5.94) | 00001 (0.68) | 00022 (0.00) | 00102 (0.00) | 00222 (0.00) |
| 00020 (2.06) | 00002 (0.00) | 00121 (0.00) | 00122 (0.00) | 01222 (0.00) |
| 01000 (10.84) | 00021 (0.68) | 00220 (0.23) | 00201 (0.00) | 02022 (0.02) |
| 22000 (5.31) | 00100 (4.60) | 01002 (0.00) | 00202 (0.00) | 02122 (0.00) |
|  | 00101 (0.24) | 01021 (0.94) | 00221 (0.01) | 02202 (0.00) |
|  | 00120 (1.41) | 01101 (0.92) | 01022 (0.00) | 02221 (0.00) |
|  | 00200 (0.91) | 01120 (1.47) | 01102 (0.00) | 02222 (0.00) |
|  | 01001 (0.25) | 01200 (0.94) | 01121 (0.00) | 20002 (0.00) |
|  | 01020 (5.12) | 02001 (0.24) | 01122 (0.00) | 20022 (0.00) |
|  | 01100 (7.64) | 02020 (2.39) | 01201 (0.23) | 20122 (0.00) |
|  | 02000 (9.01) | 02100 (4.24) | 01202 (0.00) | 20222 (0.00) |
|  | 21000 (5.83) | 02200 (0.94) | 01220 (0.01) | 21102 (0.01) |
|  | 22001 (0.26) | 20000 (1.43) | 01221 (0.00) | 21122 (0.00) |
|  | 22020 (2.29) | 20100 (1.40) | 02002 (0.01) | 21201 (0.02) |
|  |  | 20200 (0.23) | 02021 (0.47) | 21202 (0.00) |
|  |  | 20220 (0.00) | 02101 (0.72) | 21221 (0.01) |
|  |  | 21001 (0.93) | 02102 (0.00) | 21222 (0.00) |
|  |  | 21020 (3.26) | 02120 (1.90) | 22102 (0.00) |
|  |  | 21100 (5.64) | 02121 (0.01) | 22121 (0.25) |
|  |  | 22002 (0.23) | 02201 (0.25) | 22122 (0.00) |
|  |  | 22021 (0.01) | 02220 (0.24) | 22200 (0.03) |
|  |  | 22100 (1.25) | 20001 (0.00) | 22201 (0.00) |
|  |  |  | 20020 (0.97) | 22202 (0.00) |
|  |  |  | 20021 (0.00) | 22220 (0.26) |
|  |  |  | 20101 (0.26) | 22221 (0.00) |
|  |  |  | 20102 (0.00) | 22222 (0.00) |
|  |  |  | 20120 (0.26) |  |
|  |  |  | 20121 (0.01) |  |
|  |  |  | 20201 (0.01) |  |
|  |  |  | 20202 (0.00) |  |
|  |  |  | 20221 (0.00) |  |
|  |  |  | 21002 (0.01) |  |
|  |  |  | 21021 (0.46) |  |
|  |  |  | 21022 (0.00) |  |
|  |  |  | 21101 (0.46) |  |
|  |  |  | 21120 (1.48) |  |

TABLE 34-continued

| Class 1 (0, 0.013] | Class 2 (0.013, 0.025] | Class 3 (0.025, 0.042] | Class 4 (0.042, 0.1] | Class 5 (0.1, 1) |
|---|---|---|---|---|
| | | | 21121 (0.03) | |
| | | | 21200 (0.25) | |
| | | | 21220 (0.47) | |
| | | | 22022 (0.00) | |
| | | | 22101 (0.01) | |
| | | | 22120 (1.16) | |

With this classification, each genotype was recoded as belonging to their respective class and a logistic regression model was fit with the genotype risk class as a categorical variable. Key summary statistics are summarized in Table 35. Each group is described by the number of cases, number of controls, the estimated risk class population frequency, the odds ratio comparing the odds of the given risk class compared to the odds of the lowest risk class, the penetrance, the relative risk (risk class penetrance divided by most protective risk class penetrance), and the population relative risk (risk class penetrance divided by the disease prevalence: 0.03).

TABLE 35

| Risk Class | N Case | N Control | Frequency (%) | OR | Penetrance | RR | RR (Pop) |
|---|---|---|---|---|---|---|---|
| G1 | 46 | 105 | 24.2 | 1.0 | 0.012 | 1.0 | 0.41 |
| G2 | 112 | 168 | 38.9 | 1.5 | 0.019 | 1.5 | 0.62 |
| G3 | 140 | 113 | 26.7 | 2.8 | 0.034 | 2.8 | 1.13 |
| G4 | 77 | 40 | 9.7 | 4.4 | 0.052 | 4.2 | 1.73 |
| G5 | 18 | 2 | 0.06 | 20.5 | 0.204 | 16.6 | 6.79 |

Example 10

Inhibition of ICAM Gene Expression by Transfection of Specific siRNAs

RNAi-based gene inhibition was selected as a rapid way to inhibit expression of ICAM1 in cultured cells. siRNA reagents were selectively designed to target the ICAM1 gene. Algorithms useful for designing siRNA molecules specific for ICAM1 gene are disclosed at the world wide web address dharmacon.com. siRNA molecules up to 21 nucleotides in length were utilized.

Table 31 summarizes the features of the duplexes that were used in the assays to target ICAM1. A non-homologous siRNA reagent (siGL2 control) was used as a negative control, and a non-homologous siRNA reagent (siRNA_RAD21_1175 control) shown to inhibit the expression of RAD21 and subsequently inhibit cell proliferation was used as a positive control in all of the assays described herein.

TABLE 36

| siRNA | siRNA Target | Sequence Specificity | SEQ ID NO: |
|---|---|---|---|
| ICAM1_293 | ICAM1 | ACAACCGGAAGGUGUAUGA | 829 |
| ICAM1_335 | ICAM1 | GCCAACCAAUGUGCUAUUC | 830 |
| ICAM1_604 | ICAM1 | GAUCACCAUGGAGCCAAUU | 831 |
| ICAM1_1409 | ICAM1 | CUGUCACUCGAGAUCUUGA | 832 |
| siRNA_RAD21_1175 positive control | RAD21 | GAGUUGGAUAGCAAGACAA | 833 |
| siGL2 negativecontrol | GL2 | CGUACGCGGAAUACUUCGA | 834 |

The siRNAs were transfected in cell lines MCF-7 and T47D using Lipofectamine™ 2000 reagent from Invitrogen, Corp. 2.5 μg or 5.0 μg of siRNA was mixed with 6.25 μl or 12.5 μl lipofectamine, respectively, and the mixture was added to cells grown in 6-well plates. Their inhibitory effects on ICAM1 gene expression were confirmed by precision expression analysis by MassARRAY (quantitative RT-PCR hME), which was performed on RNA prepared from the transfected cells. See Chunming & Cantor, *PNAS* 100(6): 3059-3064 (2003). Cell viability was measured at 1, 2, 4 and 6 days post-transfection. Absorbance values were normalized relative to Day 1. RNA was extracted with Trizole reagent as recommended by the manufacturer (Invitrogen, Corp.) followed by cDNA synthesis using SuperScript™ reverse transcriptase.

Figure 22:
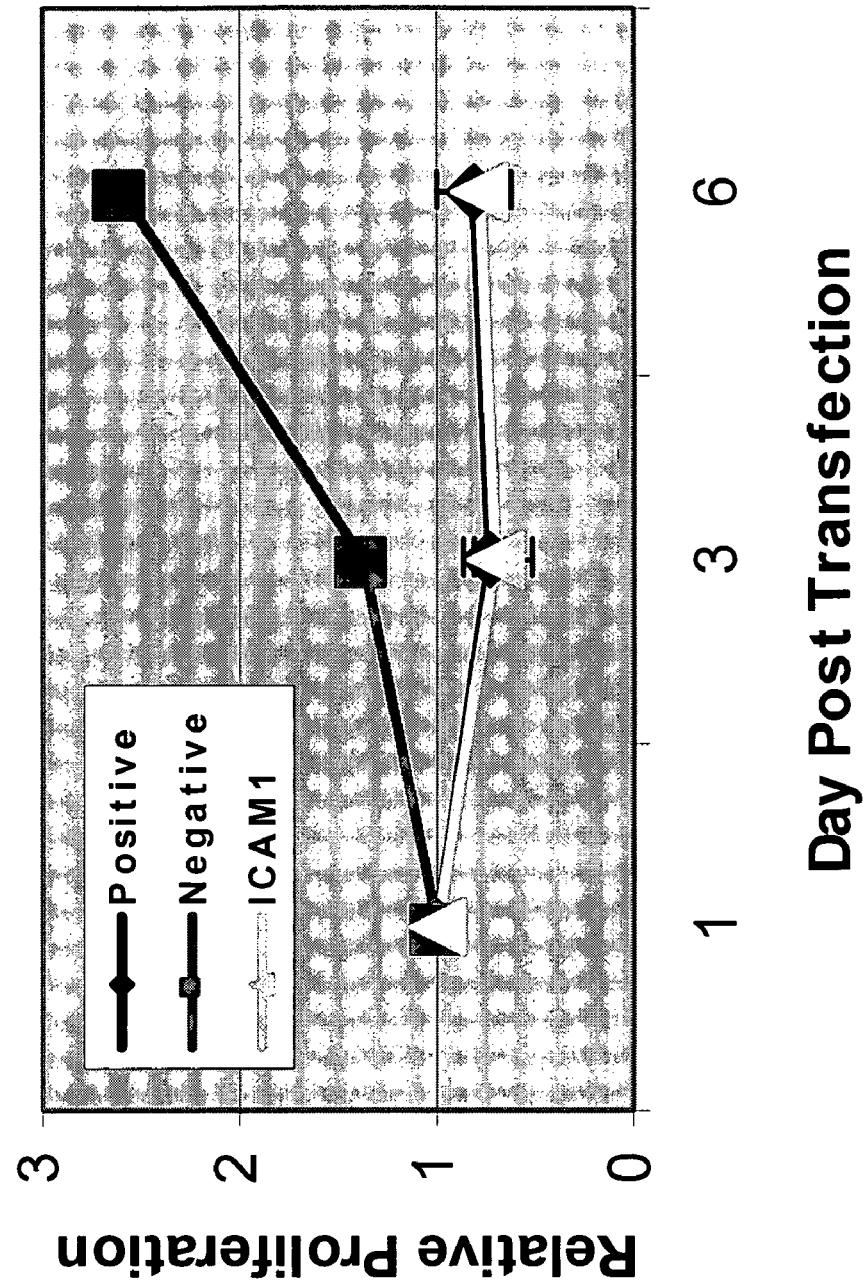
FIG. 22 shows effects of ICAM-directed siRNA on cancer cell proliferation.

A cocktail of siRNA molecules described in Table 28 (that target ICAM1) strongly inhibited proliferation of breast cancer cell line (MCF-7), as shown in FIG. 22. These effects are consistent in all six experiments performed. Each data point is an average of 3 wells of a 96-well plate normalized to values obtained from day 1 post transfection. The specificity of the active siRNAs, was confirmed with a negative, non-homologous control siRNA (siGL2), and a positive control, siRNA_RAD21_1175, that targets a known cancer-associated gene, RAD21.

Example 11

In Vitro Production of Target Polypeptides cDNA is cloned into a pIVEX 2.3-MCS vector (Roche Biochem) using a directional cloning method. A cDNA insert is prepared using PCR with forward and reverse primers having 5' restriction site tags (in frame) and 5-6 additional nucleotides in addition to 3' gene-specific portions, the latter of which is typically about twenty to about twenty-five base pairs in length. A Sal I restriction site is introduced by the forward primer and a Sma I restriction site is introduced by the reverse primer. The ends of PCR products are cut with the corresponding restriction enzymes (i.e., Sal I and Sma I) and the products are gel-purified. The pIVEX 2.3-MCS vector is linearized using the same restriction enzymes, and the fragment with the correct sized fragment is isolated by gel-purification. Purified PCR product is ligated into the linearized pIVEX 2.3-MCS vector and E. coli cells transformed for plasmid amplification. The newly constructed expression vector is verified by restriction mapping and used for protein production.

E. coli lysate is reconstituted with 0.25 ml of Reconstitution Buffer, the Reaction Mix is reconstituted with 0.8 ml of Reconstitution Buffer; the Feeding Mix is reconstituted with 10.5 ml of Reconstitution Buffer; and the Energy Mix is reconstituted with 0.6 ml of Reconstitution Buffer. 0.5 ml of the Energy Mix was added to the Feeding Mix to obtain the Feeding Solution. 0.75 ml of Reaction Mix, 50 μl of Energy Mix, and 10 μg of the template DNA is added to the E. coli lysate.

Using the reaction device (Roche Biochem), 1 ml of the Reaction Solution is loaded into the reaction compartment. The reaction device is turned upside-down and 10 ml of the Feeding Solution is loaded into the feeding compartment. All lids are closed and the reaction device is loaded into the RTS500 instrument. The instrument is run at 30° C. for 24 hours with a stir bar speed of 150 rpm. The pIVEX 2.3 MCS vector includes a nucleotide sequence that encodes six consecutive histidine amino acids on the C-terminal end of the target polypeptide for the purpose of protein purification. Target polypeptide is purified by contacting the contents of reaction device with resin modified with $Ni^{2+}$ ions. Target polypeptide is eluted from the resin with a solution containing free $Ni^{2+}$ ions.

Example 12

Cellular Production of Target Polypeptides

Nucleic acids are cloned into DNA plasmids having phage recombination cites and target polypeptides are expressed therefrom in a variety of host cells. Alpha phage genomic DNA contains short sequences known as attP sites, and E. coli genomic DNA contains unique, short sequences known as attB sites. These regions share homology, allowing for integration of phage DNA into E. coli via directional, site-specific recombination using the phage protein Int and the E. coli protein IHF. Integration produces two new att sites, L and R, which flank the inserted prophage DNA. Phage excision from E. coli genomic DNA can also be accomplished using these two proteins with the addition of a second phage protein, Xis. DNA vectors have been produced where the integration/excision process is modified to allow for the directional integration or excision of a target DNA fragment into a backbone vector in a rapid in vitro reaction (Gateway™ Technology (Invitrogen, Inc.)).

A first step is to transfer the nucleic acid insert into a shuttle vector that contains attL sites surrounding the negative selection gene, ccdB (e.g. pENTER vector, Invitrogen, Inc.). This transfer process is accomplished by digesting the nucleic acid from a DNA vector used for sequencing, and to ligate it into the multicloning site of the shuttle vector, which will place it between the two attL sites while removing the negative selection gene ccdB. A second method is to amplify the nucleic acid by the polymerase chain reaction (PCR) with primers containing attB sites. The amplified fragment then is integrated into the shuttle vector using Int and IHF. A third method is to utilize a topoisomerase-mediated process, in which the nucleic acid is amplified via PCR using gene-specific primers with the 5' upstream primer containing an additional CACC sequence (e.g., TOPO® expression kit (Invitrogen, Inc.)). In conjunction with Topoisomerase I, the PCR amplified fragment can be cloned into the shuttle vector via the attL sites in the correct orientation.

Once the nucleic acid is transferred into the shuttle vector, it can be cloned into an expression vector having attR sites. Several vectors containing attR sites for expression of target polypeptide as a native polypeptide, N-fusion polypeptide, and C-fusion polypeptides are commercially available (e.g., pDEST (Invitrogen, Inc.)), and any vector can be converted into an expression vector for receiving a nucleic acid from the shuttle vector by introducing an insert having an attR site flanked by an antibiotic resistant gene for selection using the standard methods described above. Transfer of the nucleic acid from the shuttle vector is accomplished by directional recombination using Int, IHF, and Xis (LR clonase). Then the desired sequence can be transferred to an expression vector by carrying out a one hour incubation at room temperature with Int, IHF, and Xis, a ten minute incubation at 37° C. with proteinase K, transforming bacteria and allowing expression for one hour, and then plating on selective media. Generally, 90% cloning efficiency is achieved by this method. Examples of expression vectors are pDEST 14 bacterial expression vector with att7 promoter, pDEST 15 bacterial expression vector with a T7 promoter and a N-terminal GST tag, pDEST 17 bacterial vector with a T7 promoter and a N-terminal polyhistidine affinity tag, and pDEST 12.2 mammalian expression vector with a CMV promoter and neo resistance gene. These expression vectors or others like them are transformed or transfected into cells for expression of the target polypeptide or polypeptide variants. These expression vectors are often transfected, for example, into murine-transformed a adipocyte cell line 3T3-L1, (ATCC), human embryonic kidney cell line 293, and rat cardiomyocyte cell line H9C2.

Example 13

Haplotype Analysis of the KIAA0861 Locus rs6804951 and rs2001449 are significant at the allele and genotype levels (P<0.05). Moderate LD is observed for markers rs3732602 and rs2293203 (r^2=0.646). Chi-squared tests indicate that haplotypes are significantly associated with breast cancer. Cell-specific chi-square values indicate that TTTTG and CTTTC haplotypes are contributors to this relationship. Odds ratios and score tests indicate that individuals carrying the TTTG are less likely to have breast cancer, while individuals with CTTTC are at elevated risk for the disease. Moreover, the odds ratio estimated for the CGTTC indicates more than a two-fold risk of disease among its carriers, although this result must be interpreted with great caution due to the low observed frequency in the population.

A. Summary Statistics of Alleles and Genotypes

A. Summary Statistics of Alleles and Genotypes

1. SNP Locations

| SNP.ID | Type | Location |
|---|---|---|
| rs6804951 | Proximal | 184327431 |
| rs7639705 | Proximal | 184330963 |
| rs3732602 | Proximal | 184408945 |
| rs2293203 | Proximal | 184419992 |
| rs2001449 | Incident | 184429569 |

2. Allele by GYNGroup

| | N | Case (N = 544) | Control (N = 552) | Test Statistic |
|---|---|---|---|---|
| rs6804951:T | 1064 | 5% (24) | 9% (46) | Chi-square = 6.71 d.f. = 1 P = 0.00958 |
| rs7639705:T | 1086 | 80% (434) | 81% (441) | Chi-square = 0.03 d.f. = 1 P = 0.868 |
| rs3732602:T | 1074 | 99% (532) | 99% (532) | Chi-square = 0.4 d.f. = 1 P = 0.529 |
| rs2293203:T | 1088 | 99% (536) | 99% (538) | Chi-square = 0.27 d.f. = 1 P = 0.6 |
| rs2001449:C | 1084 | 30% (161) | 22% (119) | Chi-square = 8.49 d.f. = 1 P = 0.00356 |

3. Genotype by GYNGroup

| | N | Case (N = 272) | Control (N = 276) | Test Statistic |
|---|---|---|---|---|
| rs6804951:CC | 532 | 91% (238) | 83% (225) | Chi-square = 7.13 d.f. = 2 P = 0.0283 |
| CT | | 9% (24) | 16% (44) | |
| TT | | 0% (0) | 0% (1) | |
| rs7639705:GG | 543 | 3% (9) | 5% (14) | Chi-square = 2.03 d.f. = 2 P = 0.362 |
| GT | | 33% (88) | 28% (77) | |
| TT | | 64% (173) | 67% (182) | |
| rs3732602:TT | 537 | 99% (264) | 98% (263) | Chi-square = 0.4 d.f. = 1 P = 0.527 |
| rs2293203:TT | 544 | 98% (265) | 97% (265) | Chi-square = 0.28 d.f. = 1 P = 0.598 |
| rs2001449:GG | 542 | 47% (128) | 60% (162) | Chi-square = 9.29 d.f. = 2 P = 0.00961 |
| GC | | 46% (125) | 37% (99) | |
| CC | | 7% (18) | 4% (10) | |

4. Genotype QC: Test of Hardy-weinberg Equilibrium
a. Cases

| | A.freq | D | ChiSq | Pvalue |
|---|---|---|---|---|
| rs6804951 | 0.936 | −0.002280 | 0.7870 | 0.3750 |
| rs7639705 | 0.807 | 0.004790 | 0.5150 | 0.4730 |
| rs3732602 | 0.990 | −0.000101 | 0.0565 | 0.8120 |
| rs2293203 | 0.987 | −0.000164 | 0.0921 | 0.7620 |
| rs2001449 | 0.744 | −0.014500 | 3.1400 | 0.0763 | b. Controls

| | A.freq | D | ChiSq | Pvalue |
|---|---|---|---|---|
| rs6804951 | 0.916 | −0.003400 | 0.5350 | 0.465 |
| rs7639705 | 0.808 | 0.014400 | 2.3600 | 0.124 |
| rs3732602 | 0.989 | −0.000120 | 0.0336 | 0.855 |
| rs2293203 | 0.985 | −0.000213 | 0.0601 | 0.806 |
| rs2001449 | 0.783 | −0.010700 | 1.0800 | 0.299 |

B. Summary Statistics: Linkage Disequilibrium

1. PHASE Haplotype Frequencies

| | H.freq | H.relfreq |
|---|---|---|
| CGTTC | 13 | 0.012 |
| CGTTG | 191 | 0.175 |
| CTCAG | 10 | 0.009 |
| CTCTG | 1 | 0.001 |
| CTTAG | 4 | 0.004 |
| CTTTC | 265 | 0.243 |
| CTTTG | 538 | 0.493 |
| TGTTG | 7 | 0.006 |
| TTTTC | 2 | 0.002 |
| TTTTG | 61 | 0.056 |

2. Linkage Disequilibrium Between Markers
a. r^2

| | rs6804951 | rs7639705 | rs3732602 | rs2293203 | rs2001449 |
|---|---|---|---|---|---|
| rs6804951 | 1.000000 | 0.00382 | 0.000697 | 0.00089 | 0.01860 |

-continued

|  | | | | | |
|---|---|---|---|---|---|
| rs7639705 | 0.003820 | 1.00000 | 0.002440 | 0.00311 | 0.04770 |
| rs3732602 | 0.000697 | 0.00244 | 1.000000 | 0.64600 | 0.00351 |
| rs2293203 | 0.000890 | 0.00311 | 0.646000 | 1.00000 | 0.00448 |
| rs2001449 | 0.018600 | 0.04770 | 0.003510 | 0.00448 | 1.00000 | b. D'

|  | rs6804951 | rs7639705 | rs3732602 | rs2293203 | rs2001449 |
|---|---|---|---|---|---|
| rs6804951 | 1.0000 | 0.116 | 0.0685 | 0.0685 | 0.306 |
| rs7639705 | 0.1160 | 1.000 | 0.2400 | 0.2400 | 0.262 |
| rs3732602 | 0.0685 | 0.240 | 1.0000 | 0.9080 | 0.345 |
| rs2293203 | 0.0685 | 0.240 | 0.9080 | 1.0000 | 0.345 |
| rs2001449 | 0.3060 | 0.262 | 0.3450 | 0.3450 | 1.000 | c. P-value

|  | rs6804951 | rs7639705 | rs3732602 | rs2293203 | rs2001449 |
|---|---|---|---|---|---|
| rs6804951 | 1.00e+00 | 4.12e−02 | 0.3830 | 0.3240 | 6.40e−06 |
| rs7639705 | 4.12e−02 | 1.00e+00 | 0.1030 | 0.0653 | 5.41e−13 |
| rs3732602 | 3.83e−01 | 1.03e−01 | 1.0000 | 0.0000 | 5.03e−02 |
| rs2293203 | 3.24e−01 | 6.53e−02 | 0.0000 | 1.0000 | 2.70e−02 |
| rs2001449 | 6.40e−06 | 5.41e−13 | 0.0503 | 0.0270 | 1.00e+00 |

3. Haplotype by GYNGroup
a. PHASE Haplotypes (All)

|  | Case | Case (%) | Case · X^2 | Control | Control (%) | Control · X^2 | OR | ln · OR |
|---|---|---|---|---|---|---|---|---|
| TTTTG | 20 | 1.83 | 3.55 | 41 | 3.75 | 3.53 | 0.4782 | −0.7377 |
| CTCAG | 4 | 0.37 | 0.19 | 6 | 0.55 | 0.19 | 0.6654 | −0.4074 |
| TGTTG | 3 | 0.27 | 0.07 | 4 | 0.37 | 0.07 | 0.7493 | −0.2886 |
| CTTTG | 259 | 23.72 | 0.30 | 279 | 25.55 | 0.30 | 0.9060 | −0.0987 |
| CGTTG | 94 | 8.61 | 0.01 | 97 | 8.88 | 0.01 | 0.9662 | −0.0344 |
| CTTAG | 2 | 0.18 | 0.00 | 2 | 0.18 | 0.00 | 1.0000 | 0.0000 |
| TTTTC | 1 | 0.09 | 0.00 | 1 | 0.09 | 0.00 | 1.0000 | 0.0000 |
| CTTTC | 151 | 13.83 | 2.73 | 114 | 10.44 | 2.71 | 1.3766 | 0.3196 |
| CGTTC | 9 | 0.82 | 0.98 | 4 | 0.37 | 0.98 | 2.2604 | 0.8155 |
| CTCTG | 1 | 0.09 | 0.51 | 0 | 0.00 | 0.50 | Inf | Inf |

Pearson Chi-squared Test = 16.6377, DF = 9, P-value = 0.0547
b. PHASE Haplotypes (Low Frequency Removed)

|  | Case | Case (%) | Case · X^2 | Control | Control (%) | Control · X^2 | OR | ln · OR |
|---|---|---|---|---|---|---|---|---|
| TTTTG | 20 | 1.86 | 3.55 | 41 | 3.80 | 3.52 | 0.4781 | −0.7379 |
| CTCAG | 4 | 0.37 | 0.19 | 6 | 0.56 | 0.19 | 0.6654 | −0.4074 |
| CTTTG | 259 | 24.03 | 0.30 | 279 | 25.88 | 0.30 | 0.9056 | −0.0992 |
| CGTTG | 94 | 8.72 | 0.01 | 97 | 9.00 | 0.01 | .09661 | −0.0345 |
| CTTTC | 151 | 14.01 | 2.73 | 114 | 10.58 | 2.71 | 1.3774 | 0.3202 |
| CGTTC | 9 | 0.83 | 0.98 | 4 | 0.37 | 0.98 | 2.2605 | 0.8156 |

Pearson Chi-squared Test = 15.4946, DF = 5, P-value = 0.008445
c. haplo.score Haplotypes

|  | Hap.Freq | Score | P. X^2 | P.Sim |
|---|---|---|---|---|
| TTTTG | 0.0529 | −2.1206 | 0.0340 | 0.0342 |
| TGTTG | 0.0101 | −2.0668 | 0.0388 | 0.0236 |
| CTCAG | 0.0073 | −1.2914 | 0.1966 | 0.2902 |
| CTTTG | 0.5221 | −1.2275 | 0.2196 | 0.2195 |
| CGTTG | 0.1448 | −0.1441 | 0.8854 | 0.8834 |
| CTTTC | 0.2267 | 2.3422 | 0.0192 | 0.0192 |
| CGTTC | 0.0307 | 2.6994 | 0.0069 | 0.0050 |

Global Score = 20.343, DF = 7, Global P.X^2 = 0.0049, Global P.Sim = 0.0022

Example 14

Haplotype Analysis of the NUMA1 Locus

All markers noted below except 2276396 are associated with breast cancer at the allele level (P<0.05). Marker 675185 does not maintain this relationship at the genotype level. Strong LD is observed across the entire region but is particularly strong between and among 1894003, 675185, 673478, and 615000. Pearson chi-squared statistics suggest that haplotypes are significantly associated with breast cancer. Haplotype TTCTC contributes the most to this relationship. Odds ratios and score statistics indicate that individuals with haplotype TTCTC are 2.6 times more likely to have breast cancer than individuals with other haplotypes.

Statistics

Chi-squared statistics are estimated to assess whether 1) alleles and genotypes are associated with breast cancer status and 2) marker genotype frequencies deviate significantly from Hardy-Weinberg equilibrium (HWE). Haplotype frequencies and relative frequencies are estimated, as well as several statistics ($r^2$, D', and p-value) that gauge the extent and stability of linkage disequilibrium between markers in each region. Chi-squared statistics and score tests are estimated to determine whether reconstructed haplotypes are significantly associated with breast cancer status (P<0.05). P-values are estimated for 1) the full set of reconstructed haplotypes and 2) a reduced set that excludes haplotypes with observed frequencies less than 10. Results are presented by chromosome order.

Results

Summary Statistics: Alleles and Genotypes

SNP Locations

| SNP. ID | Type | Location |
|---|---|---|
| 1894003 | Proximal | 71972974 |
| 675185 | Proximal | 71998270 |
| 673478 | Incident | 72021802 |
| 615000 | Proximal | 72025650 |
| 2276396 | Proximal | 72046603 |

Allele by GYNGroup

| | N | Case (N = 510) | Control (N-538) | Test Statistic |
|---|---|---|---|---|
| 1894003:C | 1026 | 91%(450) | 96%(510) | Chi-square = 6.95 d.f. = 1 P = 0.00838 |
| 675185:G | 1010 | 92%(451) | 95%(498) | Chi-square = 3.96 d.f. = 1 P = 0.0466 |
| 673478:C | 1022 | 8%(41) | 5%(25) | Chi-square = 5.68 d.f. = 1 P = 0.0171 |
| 615000:G | 1010 | 92%(434) | 96%(513) | Chi-square = 7.4 d.f. = 1 P = 0.00652 |
| 2276396:C | 1028 | 97%(478) | 98%(523) | Chi-square = 0.18 d.f. = 1 P = 0.674 |

Genotype by GYNGroup

| | N | Case (N = 255) | Control (N = 269) | Test Statistic |
|---|---|---|---|---|
| 1894003:TT | 513 | 1%(3) | 0%(0) | Chi-square = 7.43 d.f. = 2 P = 0.0243 |
| TC | | 15%(36) | 9%(24) | |
| CC | | 84%(207) | 91%(243) | |
| 675185:TT | 505 | 0%(1) | 0%(0) | Chi-square = 4.37 d.f. = 2 P = 0.112 |
| TG | | 14%(35) | 9%(24) | |
| GG | | 85%(208) | 91%(237) | |
| 673478:TT | 511 | 84%(207) | 91%(241) | Chi-square = 6.39 d.f. = 2 P = 0.0409 |
| TC | | 14%(35) | 9%(25) | |
| CC | | 1%(3) | 0%(0) | |
| 615000:TT | 505 | 1%(3) | 0%(0) | Chi-square = 7.8 d.f. = 2 P = 0.0202 |
| TG | | 14%(34) | 9%(23) | |
| GG | | 84%(200) | 91%(245) | |
| 2276396:CC | 514 | 4%(232) | 95%(255) | Chi-square = 0.18 d.f. = 1 P = 0.67 |

Genotype OC: Test of Hardy-Weinberg Proportions

All

| | A. freq | D | ChiSq | Pvalue |
|---|---|---|---|---|
| 1894003 | 0.935 | 0.00159 | 0.350 | 0.554 |
| 675185 | 0.935 | 0.00159 | 0.350 | 0.554 |
| 673478 | 0.935 | 0.00159 | 0.350 | 0.554 |
| 615000 | 0.937 | 0.00184 | 0.495 | 0.482 |
| 2276396 | 0.974 | −0.00069 | 0.374 | 0.541 |

Control

| | A. freq | D | ChiSq | Pvalue |
|---|---|---|---|---|
| 1894003 | 0.953 | −0.002190 | 0.644 | 0.422 |
| 675185 | 0.953 | −0.002190 | 0.644 | 0.422 |
| 673478 | 0.953 | −0.002190 | 0.644 | 0.422 |
| 615000 | 0.957 | −0.001860 | 0.541 | 0.462 |
| 2276396 | 0.976 | −0.000593 | 0.166 | 0.683 |

Summary Statistics: Linkage Disequilibrium

Haplotype Frequencies

| | H. freq | H. relfreq |
|---|---|---|
| CGTGC | 961 | 0.935 |
| TTCGC | 1 | 0.001 |
| TTCGG | 1 | 0.001 |
| TTCTC | 39 | 0.038 |
| TTCTG | 26 | 0.025 |

Linkage Disequilibrium Between Markers

| | 1894003 | 675185 | GP11.079035103 | 615000 | 2276396 |
|---|---|---|---|---|---|
| | | | $r^2$ | | |
| 1894003 | 1.000 | 1.000 | 1.000 | 0.968 | 0.387 |
| 675185 | 1.000 | 1.000 | 1.000 | 0.968 | 0.387 |
| 673478 | 1.000 | 1.000 | 1.000 | 0.968 | 0.387 |
| 615000 | 0.968 | 0.968 | 0.968 | 1.000 | 0.369 |
| 2276396 | 0.387 | 0.387 | 0.387 | 0.369 | 1.000 |
| | | | D' | | |
| 1894003 | 1 | 1 | 1 | 1.00 | 1.00 |
| 675185 | 1 | 1 | 1 | 1.00 | 1.00 |

-continued

| | | | | | |
|---|---|---|---|---|---|
| 673478 | 1 | 1 | 1 | 1.00 | 1.00 |
| 615000 | 1 | 1 | 1 | 1.00 | 0.96 |
| 2276396 | 1 | 1 | 1 | 0.96 | 1.00 |
| X | 1894003 | 675185 | GP11.079035103 | 615000 | 2276396 |
| P-value | | | | | |
| 1894003 | 1 | 0 | 0 | 0 | 0 |
| 675185 | 0 | 1 | 0 | 0 | 0 |
| GP11.079035103 | 0 | 0 | 1 | 0 | 0 |
| 615000 | 0 | 0 | 0 | 1 | 0 |
| 2276396 | 0 | 0 | 0 | 0 | 1 |

Haplotype by GYN Group

| | Case | Case(%) | Case.X^2 | Control | Control(%) | Control.X^2 | OR | ln.OR |
|---|---|---|---|---|---|---|---|---|
| PHASE Haplotypes (All) | | | | | | | | |
| TTCGC | 0 | 0.00 | 0.48 | 1 | 0.10 | 0.44 | 0.0000 | −Inf |
| TTCGG | 0 | 0.00 | 0.48 | 1 | 0.10 | 0.44 | 0.0000 | −Inf |
| CGTGC | 452 | 43.97 | 0.21 | 509 | 49.51 | 0.19 | 0.8001 | −0.2230 |
| TTCTG | 14 | 1.36 | 0.18 | 12 | 1.17 | 0.17 | 1.1690 | 0.1561 |
| TTCTC | 28 | 2.72 | 4.57 | 11 | 1.07 | 4.23 | 2.5887 | 0.9512 |
| Pearson Chi-squared Test = 11.4058, DF = 4, P-value = 0.02236 | | | | | | | | |
| Permutation Test P-value = 0.14 | | | | | | | | |
| PHASE Haplotypes (Low Frequency Excluded) | | | | | | | | |
| CGTGC | 452 | 44.05 | 0.25 | 509 | 49.61 | 0.23 | 0.7998 | −0.2234 |
| TTCTG | 14 | 1.36 | 0.18 | 12 | 1.17 | 0.16 | 1.1690 | 0.1561 |
| TTCTC | 28 | 2.73 | 4.53 | 11 | 1.07 | 4.21 | 2.5888 | 0.9512 |
| Pearson Chi-squared Test = 9.5506, DF = 2, P-value = 0.008435 | | | | | | | | |

| haplo.score Haplotypes | | | | |
|---|---|---|---|---|
| | Hap. Freq | Score | P. X^2 | P. Sim |
| CGTGC | 0.9410 | −2.0316 | 0.0422 | 0.0531 |
| TTCTG | 0.0248 | 0.3232 | 0.7465 | 0.8344 |
| TTCTC | 0.0321 | 2.6973 | 0.0070 | 0.0093 |

Global Score = 9.1386, DF = 3, Global P. X^2 = 0.0275, Global P. Sim = 0.0212

Modifications may be made to the foregoing without departing from the basic aspects of the invention. Although the invention has been described in substantial detail with reference to one or more specific embodiments, those of skill in the art will recognize that changes may be made to the embodiments specifically disclosed in this application, yet these modifications and improvements are within the scope and spirit of the invention, as set forth in the claims which follow. All publications or patent documents cited in this specification are incorporated herein by reference as if each such publication or document was specifically and individually indicated to be incorporated herein by reference.

Citation of the above publications or documents is not intended as an admission that any of the foregoing is pertinent prior art, nor does it constitute any admission as to the contents or date of these publications or documents. U.S. patents, documents and other publications referenced herein are hereby incorporated by reference.

SEQUENCE LISTING (835 sequences)

SEQ ID NO: 1 - DNA, 92500 bp, Homo sapiens
agcgagactccgtctcaaaaaaaaaaaaaaaaaaaaaaaagccaggcgaggtgactcacacccataatcgcagcactttgggaggccaaggcgggcagatcgcttgagcccagaagtttgagatctgcctgggcaacayggcgagaccctgtctctatgaaacaagaaaaaagaaagaaacgaaatactgttccatcatttgccacataaaatctaaactctctggtgcagaacagacttgcaaatctgcctgtaaaatcatacaccggattttggagtagacacacaggaggctgattgtagtggtggcttctgggagaagaactggggggtagggggcacagataagagtagacagaattttcactctagtaatctttgtaatttttgaaattctctctaccaggtgtatgaatgaccaatgaaaatatacaataggccaggcgcagtggctcacgcctataatcccagcactttgggaggctgaggcgggtggatcacatgaggtcaggagtccgaggccagcctgaccaacatggtgaaaccttgtctctacgaaaaatacaaacattagtcaggtagggagcatcacttgagaacaggagttcaagaccagcctggacaacaaagcaagacctctgcctctacaaaaaaaaaaaaaaaaaaaaaaaattgctgggcatggtggaacatgcctgtggcctcagctacttaggtggctgcagcagaggatcatctgaggccaggaattcaagactacagtgaactataatcgttacactgcactacagactggtaacagggtgagatcctgtctcaaaaacaacagcaacaaaataaacgattaaaagaccttttaaagttgcaaaatacatagagtcttaaacatgcatccacagttatttatttatttatttagaaacggagtttcactcttgttgcccaggctggagtgcaatggtgcggtatcagctcactgcaacctccgcctcccaagttaaaggaattctgcctcagccttccaagtagctggaattacaggcatgcgccaccatgctcggctaattttgtatttttagtaaagatggggttttggcatattggccaggatggtttcgaacccctgacctcaggtgatccacccgcctcggactcccaaagtgctaggattataggcatgagccaccacgcccggccgcattcagttattcttgcagggataaaatacacaatgaaatacactatactttttgttttctttctttcttttttttttttttttttgagacagagtctcactcgtcgcatgggctggagtgcggtgcgggatctcggctcactgcaacctctgcctcctgggttgaagcgattctcctgcgtcagcctcccgagtagctgggattacaggtgcccgccactacgcccagctaatttttttgtatttttagtagagataaggtttcaccatgttggccaggctggtctcgaactcctgactcgtgattcgcccaccttggcctcccaaagtgctgggattacaggcgtgagccaccgcacccggccacatttttttttttttttttttgagacaggatcttagtctgtcacccaggctggagtacagtggcatgaacatggctcactgcagcctcaatctcttgggttcaggtgatccttctgccttagcctccccattagctgggaccacaggcatataccatcacacctagctaatttttaaatttttggtagaggccaggcgcggtggctcacgcctgtaatcccagcactttgggaggccgagtcgggtggatcacctgaggtcgggagttcgagaccagcctggccaaaatggtgaaaccctgtctctactaaaaataaaaaataaaaataaaaattagctgggcgtagtggcgggcgcctgtaatcccagctactcgggaggctgaggcaggagaatcgcttgaacccaggaggcagaggttgcagtgagccaagatcgcgctactgcactccagcctgggcaacagagtgagattctgtctcaaaaaaaaaataataataatgctatttattgactttacaccttgtaccaggcatgggaagctttgcctccattacgtcactgaatctcataacctccttttccagcagaggaaaatgaggttggttcacagaccacgttgtcagctgtgctctgtccagaacgcactggcctccaagtagacagccctggactggtagggaagccggctatgatccggtggcgccccctggaggtctatcgggaacatggtaaagaacctaaaaatgggtgggccacagtagctcatgcctgtaatcccagcactttgggggaccaatgcgggagaattgcttgagcccaggagttcaagaccagcctgggcaacattgggagacccaccccccgccatctctacaaaaaaaaaattaggccgggcgcggtggctcaggcctgtaatcccagcactttgggaggccgaggcgggtggatcacctgaggtcaggagttcaagaccagcctggccaacgtggtgccacactgtctctaataaaaacacgaaaattagggccgggctcggtggctcacgcctgtaatcccagcactttgggaagccgaggcgggcggatcacgaggtcaggagattgagaccatcctggctaacacggtgaaaccccctctctactaaaaatacaaaaagttagccaggtgtggtggcgggcgcctgtagtcccagctactcggtaagctgaggcagggaatcgcttgaacccgggaggccgagatgtgcgatctcacaccactgcactccggcctgggcgacagagcgatactccatctcaaaatacaaatacaaaataaaaaaatacaatacaaaaatgagccgggcttgcgtacctgtagaccagctactcaggagacagaggcaggagaatcccttgagctctggaggtcgaggctgcagtaagccatgatcttgcccattgcactccagcctgggcgacagaggaagaccttgtctctaaaaaccaaaacaaagaaactaaaaataagcattcggatttgttagggggcgacaagggaggcactccaggatctgtggactccccactttgttctgtccttggagagccctggaaggtctgagaggggacgggacctggtttaagggggtaggggagaggaccctggtctagggggtaagggacacaaatacctaatctgaggggtttcggggggacatggccctgccctggggaatctaaactgggaggcatggtctggcaggcccaatcctgaaggctttctgagggcaataaggccctgcctttaaacaaatgaaaaaacgccaggcacggtggctcacgcctgtaatcccagcactttggaaggctgaggcgggaggatcacgaggtcaggagatcgagaccatcctggctaacgcggtgatacccgtctctactaaaaatacaaaaaattagccaggcgtggtggcgggcgcctgcagtcccagctactcgggaggctgaggcaggagaatggcgtgaacccaggaggcggagcttgcagtgagccgagatcgcgccactgcactccagcctgggcaacagagcaagactccgtctcaaaaaaaacaaaaacaaaaacaaaaacaaaaacaaaaaaacaaataaaaaaacaaaaccacataactggataaagaaaaaaccatctccgacagccttggaggcgggatgaaggcgtggcccggtgggcgtgaccaacagcaaaagtttaagcgttattggctgtattccttagttgctcactccagaactgcccacttatgggcgggggtcactccttcaggcttaacagtcattggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccaggtgaggccaggggctggaggcgtggtcgaaggatgaaatttgggggtgtccaggggtcgtctctcactttcgcccaacccttgcagggcctgagttccctggcggaagaggcagcgcgtgcgaccgagaacccggagcaggtggcgagcgagggtaaggcaaccggggtggctccaggaggggcggcgacagagaggtctgacccttgaccctaacctctgacccccgcaatcgctccaggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggtgagcgagggctgtaatggtgaactgagtggcagagggatgaagagcgggatttcaggagtcacgatgactttgggcttgtacccttgggaaagtgctgtatttctacagcctccgtttctccacctgtcaaaggggaatgatgacagtttcccctgctgtagcgctgtgtgagattgaagcctgagaggtgacatcatctaagggttagggagacagaattctggagcccgactgattaggttcaaatcctgccttcccctcttgtccctcagtgtccctattttgtcagcggtcgggaggttgctgtgatgaataaatgacttaattctggcacataataagttctatagaaatgttgataatctttgttaactggtttttgcaaataagagcactaaaaagactaaaccattcctcggtgcctggaagaggctgtttgcattttagttaccctgctgttcataacatctctaagaaaatgtaggggccaccctgggcgcagtggctcacgcctgtaatcccagcactttgggaggccaaggcgggcggatcacgaggtcaggagatcgagaccatcctggctaacatggtgaaaccccgtctctactaaaaatacaaaaaaaaattagccgggcgtggtggcgggcgtctgtagtcccaggtactctggaggctgaggcaagagaatggcgtgaacccgggaggcggagcttgcagtgagccgagatcgcgccactgcactccatcctgggcaacactctgtctcaaaaaaaaaaaaaaaaaagaaagaaaagaaaatgtaggggccagttactgtggctcacatctgtaatcccagcacattgggaggccgaggtgggcggatcacttgaaaccaggagttgcagaccagcctggccaacatgatgaaaccccgtctctaccaaaaatacaaaaattagccggacgtcttagtgcaagcctgtagtcccagctactcaggaggctgaggcatgagaatcgcttgcacctggggagatggaggttgcagtgagccgtgattatactactgcactccagcctgggcgacagagacagactccatctcaaaaaaaaaaacaggtgaaattgatttcaataatgtatttaacctgtatttaaaactatgtcgaaatcacattgtagcatggggcactggccatgtttcagatgttgagtatgtgactgtatggaatggtatagaactagagaggaaaaccagtccctgaagaaggtggcaataagtgaagtgtaatagcaggaaaaaagtaatggtaggaaaaacaaggaagaaggggtggctttttttttctgagatgaagtttcgctcttgtcgcccaggctggagtgcaatggcatgctctcagctcacttcaacctccgcctcctgggttctactaattctcatgcctcagcctcccgagtagccagaatgacagacatgtaccaccgtgcccagctaatctttgtatattttggagagacatcactttgccatgttgcccaggctggtcttactccttgcctcaagtgatccacctgccttggcctcccaaagtgccaggattccaggcatgagccactgcacctggtcagggtggctctttctttagaaggtacctttcagcagttattggagctgctacctgtaggctgagaaagaaccatccaggagaagagtgtttcaggcagagggaacagcaagtgccaaggccctgaggcagaatttcaagatggggtcagtgaggggcagaggcaaatcgcccagggccctggaggcagaagggagaatcctgggttttcctatagtggggtgggagcgtttgaagcagagttgggcttctcatgtgtccttcctccccgcaggctggacatactgcaccaggttgctatgtggcagaagaacttcaagagaattgtgagtgcctaaatggagcaaggtggtgggaaggagcttcctggggaggttggggataggacccagaggaagcccatcgctgggttttctctggactgctcggctggggcctcatctgtctcctgaactattcaccgatgggtccatttttggttctcttttttttgtttgtttttgagatggagatggagtctcactctgtcacccaggctggagtgcagtggcgcaatcttggttcactgcaacctccgcttcctgggttcaagcgattctcctgcctctgcctcctgagtagctgggattacaggtgtgcaccaccatgcaggctaatttttgtatttttagtagagatggagtttcaccatgttggtcaggctggtctcaaactcctgacctcaaggaacctacctgccttggcctcccaaagtgctgggattacaggcgtgagccaccgtgcccagctcattttcagttgttttctgatcactcactgatgtgggcattgtggtgggtgagaggatatagcagggaccacgaggacaaaacaggcaaggtccggctgtgtgcaagtggctcaggcctgtaatcccagcactggaagctgaggtgggtgggttgcttggggccaggaaagaccagcctgggaaacagcaagacccagtctctaccccttcccccacaaccccaagaaaaagatgggcaaagtccctattctaatgaaggtcacagtgtcatgggaggagaagtgaaggtgagtcagatggtcatacgtaatgtgtaattatgagcatgtcccagagaatgggacgttcaaccttgggtctactgtagaagctaaccagatcaaggaggcagtggggctagtgtggagataacaggaacagggtgtgcaaaggccctgtggcagggaccacaaggaagccagtgttgccacagaggccagtgggagcagtggggaggagtctgggttttgtgccaagaacattgaagaatccattaccagtcagggtcttatccatccaccccagaggtctggccagtcctccccctgctcacaccttccctggctccccatcaccctaggaataaagtcatcagtctgctattctgagttcttcctgatttccttgccctgctcctctttcctgattctccctgtctgtgtcatttcccatggccctccctccttgtggctacaaccacattaaaattgttcaaaaaataggccggcacggtggctcacacctgtaatctcagcactttgggaggccaaggcaggtggatcacttgaggccaggagttccaaaccagcctagtcaacgtggcaaaaccccatctctactgaaaatacaaaaaattagctggggccaggtgcggtggctcacacctgtaatcccagtactttgggaggccgaggcggatggatcacgaggtcgggagatcgagaccagcctgaccaatatggtgaaaccccatctctactaaaaatacaaatattagttgggtgtggcagcgggcgcctgtagtcccagctactctggaggctgagacaggagaattgcttgaacctgggaggcggaggttgcagtgagccgagatcgcgccactgcactccagcgtgggcgacagagcgagactccatctcaaaaaaaaaaattagccgggcatggtgacaggcacccgtaatctcagctactagggaggctgaggcaggagaatcgcttgaatctaggaatcagaggttgcagtgagccaaggtcacaccacttgcactccacagcctgggtgacagagtgagactgcctcaaaaaaaaaaatcaatagttcagaaaataccgagcaccccctgcgtgcccggtggcagggcccctgcctttgtgaggctggcatggggcaggagctgtgacttctttaccctccccctcgctccccaagtactctgtgcttggccagagagagcccgtcatcatggtgcctcctgtctgacttccccgtggcaggactgatctgcccggctccctgacacctgcctcgtggacctgacccccctcctctttgtgcctccagagctatgccaagaccaagacgagagccgaggtgcggggcggtggccggaagccttggccgcagaaaggcactgggcgggcccggcatggcagcatccgctctccgctctggcgaggaggtaacaggacagggtggagggggcggggaggggtgggggggccagggaagggcctgggtgtttactcacacacagctgcgcacatctggcatggtattatgtcagccctgttccctccacctcatggaaccacctgggctggtgacatcggaactgaggcccttggacctcactacccatataaggggacagagatctgggagccatccactcctccctctcgcatgccctgtctcttcagcctgtggccacagcccctcttgaccccacctcctgtcaccctctcctgacccacacttcccacagcacccagagagctcttctaaatcgtggaacctgaactccggacctcggcctttgtgtggaacctgaactcctgaccttgtcattgtgggccctggtggctgcacacctttccccctcatcccctcctttccctctctgaccaggcagagatgactctctcttgttttttcggttgtgtttgtttttaactttttattttcttgaatgctaacaagatgactcagggtggtgccagccaccccatcacctgtttacctggccagctctcctcacctttcagggttctgggccacacctcctccaggaagccccccttgatctcctttccttccacatcccccggagctaccctgatttcttctacagctgagcctcttttctgccctgccggaatgtgaatggcatgagggcagggaccatgtctgttgtcttctctgctgcatttccaaggcccaggcgagggcagacaccaacacatggtgcttgcaggggtctccctgactgttgttgctcccagatcatactgcttgctccaccggagcatgtgcctgatgccttcctctcccgcttgacctgaaagttcgaacctcctgataacttcagcattaacagcgtgcttgagttaagttcacactctagccactctatggaatccacaccataactcatggtgtcctatggggcaggaactgtccgatctcaaggtggtttgttttttttattgtttgcttttgagacaagatctcgctctgttgcccaggctgtagtgcagtggtgcaatcatagctcactgcagccttgagctcctgggctcaagtgatcctccatcctcagcctcccaaaatgctggtgtgagccaccttcgccagccctgtctcagagtgtgacagctgggaaaactgaagcccagtgaagcaaagtcactggtcccatgttgtccctgatccagcctcccctgaggccccaccctctctgccttgttcctggcagcgccccctctctcgtcaccccatgccagccactgcagcagattgctgacctccaggctctgcagtggcccctacctgctcacatgcctctgtccccgcaggaggtgttgcccatggcccccggggccccacaagttactactacatgctgcccatgaaggtgcgggcgctgggtctcaaagtggcactgaccgtcaagctggcccaggtacagccatgggggggcccagacagctgctagaggtggggctgctctggacccagggttcaaaccatcctttccttccaccaggacgacctgcacatcatggactccctagagctgcccaccggagacccacagtacctgacagagctggcgcactaccgccgctggggggactccgtactcctcgtggacttgtgagggcacagggcagagcaggggcagggggccctgagctccgtactctgagggttcaacccccactccctggcctctcttacagaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgawgtgaagcacctcttctgagccaggccgagcccctggccgacttgggagcctyaggcccacgcccacccttcgaggaaggtgtcacctggaccccttcattccacggaggaagctgaggccacagggagcggccatcgccattgggaaggggcgactccacggaragcccagacgggcttctgcatccattccctctttttgtttttaaaataaattgtatttttgaatcaaggaggataaagataacttctcagtgtcatttttgataattgcattgagaacgatgagctccttcccaggttctgggcactgttggggatccgccgtctcaagaggctcacggtctggtttaggggaaccccagggctgtttgtggaaattacaagaattcacttacccggtgagtcagactccaggagctcacaggtgcgtgggcgctggcacttcctaggagctgactcctgccacatccctctcctgagcactgctgccagccattctcacccctgagagggtttgcagtcctgtctgcgacagtacttcatgcagcctgagagtgtgtgcttgattgtacaagtagatgttgtgtaaacctgagttttcagagtgacttcctgtaagcacagtcagaaaagtaaatgtctctctgtaagtgagcagataagcacatgcttaaaaacaccagctgggcgtggtgactcgcacctgtaaccctagcactttgggaggtcaaggtggaaggatcgtttgagctcagagcttccagaccagcctgggcaacatggtgaaaccccatctctgcaaaaaatataaaaattaagtgggcgtgttggcgtccacctgtggtcccagctacttgggaggctgaggtgggaggatcacctgagcccaggaagcagaggttgcagtgagctgagactgagccaccacacaccagcctgggtgacagagtgagacactgtcttaaaaccccaatatcccaatttttgagtttgctgaggttgccagccaagttaatttttcttaacagccataacagactataatatagacaatgtgatcgatttatttaaagtcaaccagctgggcgcggtggctcacgcctataatcccagaattttaggaggctgagccaggtggatcaccggaagtcaggagttcgagaccagcctggccaagccgggagtggtggcgggcacctgtaatcccagctacttaggaggctgaggtgggagaatcgcttgaacccaggaggcagaggttgcagtgagccaagatagcgccactgcgctccagcctgggtgacagagcaagattccatctataaataaataaataaataaagtcaatcaggactgccttctgcctgtgtgggcctggccaggctaagcagccacacaaccctccctacctgctgggccacccctggctgaaaacctctctggaatgcctctcttgggattgccttcagagattgcaacacattctccaaacaccctcagtggacatagactttgatccttgaagcagcagatttgactaagtaaaaaagaaaaagctattaaaaccagttggctgggcgcggtggctcacgcctgtaatcccagcactttgggaggccgaggcaggcggatcacgaggtcaggagatcgagactatcctggctaacacagtgaaaccccatctctaccaaaaatacaaaaaattagccgggcgtggtggtgggcgcctgtagtcccagctactcaggagactgaggcaggagaatggtgtgaacccgggaggtggagcttgcagtgagccgagatcgcgccactgcactccactccagcctggcgacagagctagactgtctcaaaaaaaaaaacagaggcgtgccaaagctcagcagaaaatgccgcctcatcactcttcctcttgccagtcttgtgggggcaccaaggcctagagtaacacccagctgttggcctgacagtgcctggcccagcctggagagttgcagccagaagtataaatgtggttcagtctgcgtcatacctgtcaggaaacatggtgagaccaactgctgcccagacggattttcaaaagaaatgggtcagaacgtattcccccacactggaatccctcagccagattgaggataaaaacaggcatcagaaaaaaatgatacaggcaggcctggtggctcatgcctgtaatcccagcactttgggaggctgaggcgggaggatcgcctgagcacaggagtttgagaccagcctgggcaacacagtgagaacctatctctactaaaaatagaacaattagccaggcacggtggtgtggctgtggtcccagctactctggaggctgaggtgggaggatcacttgagccctaggggtagaggctgcagtgagcggagatcaccccactgcaatccagcctgggcaacagatcaagaccctgtctcaaaaaaaaaaaaaagaaaagaaaacaaaagaaaaatatgatacactgactagaatgtgctttaaaataattggcatagttgggtatggtggcatgcacctgcagtctcacctacttggaaagctgtggccaggagtttgagaccagcctgggcaacacagcaagacctcatctctataaaaaataggcggggagcagtggctcacgcctgtaatcccagcactttgggaggccaaggcaggcggatcactagaggacaggagttcaagaccagcctggccaacatggtgaaaccccatctctactaaaaatacaaaaattggcaggatgtggtggcgggtgcctataatcccagctacttgggaggctgaggcaggagaatcgcttgaacctgggaggcagaggttgcagtgagccgaggtcatgacactgccctcaaacctgggtgacagagcaagactcggtctcgaaaaaaaaaataatgaatgaatgaattaattcattaattaaatagggggggtatatgagtttgttagggctgccgtaggagtgccacaaactgcaggggttgggggggttagtcaacagaaatttattctgtcctgtttctggaggctggaagtccaaggtgaagaacagggttagctccttctaagggaaaatctgttccagatccctctcctagcgtctggtggtttgctttgctgactatctttgacattccttggcttgtagccacactgcttcagtctccaccttcatctttacatgatgttgtccctgtgggtatgtgtctgtttctgtgtctaaatttctcctttttatttttttcttttttctctatctttttttttagacggagtcgcgctctgttgcccaggctggagtgcagtggctcgatctcggctcactgcaacttctgcctcctgggttcaagcgattctcctgcctcagcctcccaagtagctgggattacaggcgcccaccaccatgcctggctaatttttgtgtttttagtagagaaggggtttcgccatattggccaggctggtaacctcaggtgatccacccgctttggcctcccaaagtactgggattacaagcgtgagccaccgaacctggcctattttttcatttatttttagacagagttttgctcttcttgtccaggctagagtacaatggcgcaatctcggctaatctcaacctccgcctcccgggttcaggcgattctcctgcctcagcctcccaagtagctgggattacaggcatacgccacaatgcctggctaattctgttttgttagcagagatggggtttcaccatgttggtcaggctggtctcgaactcccgacctcaggtgatccacccacctcagcctcccaaagtgctgagattacagacacgagccactgagcctggccctctcctttttatttttaaaatatattttgtggacggcagcagtggctcacacctgtaatcccagcactttgggaggccgaggcgggtggatcacaaggtcaggaactcgagaccagcctggccaatatggtgaagccccatctctactaaaaatataaaaattagccaggcatggccgggcgcggtggctcacgcctgtaatcccagcactttgggaggccgaggcgggcggatcacgaggtcaggagatcgagaccatcctggttaatacggtgaaaccccgtctctactaaaaatacaaaaaaaaaattagctgggcgaggtggcaggtgcctgtagtcccagctactcgggaggctgaggcatgagaatggcgtgaacccgggaggcggagcttgcagtgagctgagatcgcgccactgcactccagcctgggtgacagagtgagactccatctcaaaaaaaaaaaaaaaaaatttagccaggcgtggtgtcagaagcctgtagtcgcaactacttgggaggctgaggcaggagaatcacttgaacccaggaggtggaggttgcagtgagccgagaccacatcacggcacatctaaaaaaaaaaaaagttttctgtttttgttttttgcaaaactactgaaataaatacagtgagatatttatttataaatgagaacgaattaataatgagccgtaggctgggtgtggtggctcatgcctataatcccagcattttggggggccaaggcaggtggaacacttgaggtcaagagttcgagaccaggctgaccaatatagtggaaccccatctctactaaaaatacaaaagaattagccgggcatggtgccgggcgcctgtaatctcagctatgggaggctgaggtaggagaatcgcttaaaccctggaggcggaggttgcagtgaggcgatatcacgccactgcactccagcctgggggacagagcgagactccatctctaaataaataaataaggagctgtatttcaaaatttggagaaggtgacactgagagtactgaatacacagttttttgtttttttggttttttttgagacagagtctcgctctgtcacccaggctggagtgcagtggtgcaacctcggctcactgcaatctctgcctcccggttcaagcaaatctcctgcctcagcctcccgcgtagctgggattacaggcacgcatccccatgcctggctaatttttgtatttttagtagagacgggatttcaccatattggtcaggctgatctcaaactcctgacctcgtgatctgcctgcctcggcctcccaaagtgctgggattacaggcgtgagccaccgagcctggccccaaaaaatatttatcaaaactatgttaatgctggccgggtgcggtggctcatgcctgtaatcccagcactttgggaggccgaggcaggtggaacacgaggtcaggagattgagaccatcctggctaacacggtgaaaccccgtctctactaaaaaatacaaaaaattagccgggcgcggtggtgggtgcctgtagtcccagctactcaggaggctgaagcaggagaatggcaggaaccggggaggcagaggttgtagtgagctgagatcgcgccattgcactccagcctgggcgacagagcgagaatccgtctcgaaaaaaaaaaaaaaatacacacacacacacaaaaactgtgttaatgcttaactacacaaaaatgataatcagataaatatgcatttatttagagaactgcatgttggtcagtccagtccctgcagagggaattcccagcatgacctcattcacttgtgaagacagagcaatccttgtgttttatttttttaagatggatctcactctgttgcccagactggagtgcagtggcatgatctcagccctctgccacctccaccttccgggttcaagagattctcatgcctcagcctcctgagtagctgagattacaggcttgtgcctccatgcccagctaatttttttatttttactagagatgaggtttcaccagtttgggcaggccggtctcaaactcctgacctcaagtgatccacccacctcggcctcccgaagtgctgggatgacaggtgcctggtcagcaactgttgtttagacatacacattttatctgctcgtccagcatggtcagccctccactttttaaattttattttatttatttttttgagacagagtctcactctgttgtccaggttggagtccagtggcgtgatttcggctcactgcaacctctacttcccaggttcgagcaattctcctgcctcagcttcccgagtagctgggattacaggcccgcgtccccacacctagctaatttttgtatttttagtagagacagggtttcaccatgttggccaggctggtctcgaactcctgacctcaggtgattctcctgccttggcctcccaaagtgctgagattacaggtgtgagccactgcacacggccttaaattttatttattatttatttatttatttatttagagacttagtctcactctgttgcccaggctggagtgcagtggcatggtctcggctcactgcactccacctcctgggttcacgccattctcctgcctcagcctcccgagtagctgggactacaggcgcccaccaccactcccggctaatttttgtatttttagtagagatggggtttcactgtgttagccaggatagtctcgatctcctgacctcgtgatccgcctgcctcggcctcccaaagtgctgggattacttattttgttttttgtagagacaggttctcactgtgttgcccaggctggtcttgaactcctgatctcaagtgatcttcccacctcagtctctcaaagggctgggattacaggggtgagccactgcaccccaccttccctctactttttgacggtttccttctgctatgaatgtgcatgtccagttgtctgcttcttagaactgatatttaccttcctcatccatcagccattggaggaggactgggaccgctcagattattgatctgacccattctttcggcagggtttcctggtggctgtcttccatcaccaaaactggaatcagaagagtttccatagccctttttttttccccacatctttgctgaagcagagttttgaaaaacaaaaccacaaactaagctattccccagaagaaatctgtaatcaaagataagctctgccgggcacagtggctcacgccttttggaggccaaggcgggcggatcacctgaggtcaggagttctagacctgccaggccaacatggtaaaacctcatctctactaaaaatacaaaaattagctagatgtggtggtgggtacctgtagtctcagctacctgggaggctgaggcaagagaatcgcttgaacctgggaagtagaggttgcagtgagccgagattgcaccactgcactccagcctgggcgacggagtgagacgacctcacaaaaatttacataaataaaatgaaaagtaaaataaaaatacaaaagttggccgggtgcgtttgctcacgcctgtaatcccagcactttgggagggtgaggcaggcagataatgaggtaagaagatcgagaccatcctggctaacacggtgaaaccctgtctctactaaaaatacaaaaaattagctgtgcgtggtgacacgcacctgtagtcccagctatttgggaggctgaggcaggagaatcacttgaacctgggaggtggaggttgcagtgagccgagatcgcaccactgcactccagcctgggccacagagtgagactccatcttgaaaaaaaaaaaaaatacaaaagttagccaggggtgttggtgggtgcctgtaatcccagctatttgggaggctaaggcagaagaatttcttgaacctaggaaacggaggttgcagtgagccgagatcacacctctgtactccagcctggacaacagagcgagactttgtctcaaaaaaaaaaaaaaaaaaaaaactaaataggccgggagcagtggctcatgcctataatcccagccctttgggaggccaaggcaggtggatcacttgaggtcaggagtttgagaccaggctggccaacatggtgtaaccccgtctctactaaaaacacaaaaattagccgggtctggtggcgtatgtctgtaatcccagctactcgggaggctgaggcaggagaatcacttaaacctgggaggcaggggttgcagtgagctgagatcgtgccactgcactctagccagggtgacagagtgaaactctgtctcaaaaaattaaaaaagaaattcagcaagtaatgagttaaggaattcgaatattaaggcgagtgacaaggaacgcccaggatgtggcccaggatggagtaggggggacactcatttaggagaaagctcaggccacaagacaggaggagccagccttgttggggttgaagggaagagcattccaggctgagggaactgcaaggcgtttgcatgggacactatgggatggcttctgcccttggtgggcagcctctggtctgaggccattctttggcctgcctgactgtctggcaaccgggaggaagccctgcccttcctggagacagaaacaaaggtctaggaaatatctgcttcccttttccttgaaaaacgcttaagggaacggaggactgggaggtgccgtctctctctgccagcctgccccctaccatagccatcccactcccatctcagaaagtgacccgccatcctccaaaaggctcggaccctgatcaaggagtcatcccccttgtcccagcacctccagttggcccagcctccaaaacggatgtcaaattcagccctttctccaaggacactgcccagtccaggccccactatcattcatctggactagaacagtcacctcctctcccatctcctggctgcagctcttgaagcctcaactgggcccctgtgaacacttgagttagggcaaggtccttcctctgctcagaaccctctatacctcccacctcgctgggcataaaagccaaagtcctggccaggcacggtggctcacatctgttatcccagcactttgggaggccaaggggggcggatcactagaggtcaggagttagagaccaacatggtgaaaccccatctctactaaaaatacaaaaattagctaggcgtggtgacgcacccctgtagtaccagctactcggtaggctgaggtgggagaatcgcttgaacctgggaggcagagtttgcagtgagccgagatcacaccactgtgctccagcctgggtgacagaacgagactggggttcagaaacaaacaaacaaaacaacaaagtcctcctcaggtgacaggaacttgcacctatctgccctgtcatctccctgcccgctcctctcctcgaatctctcctttgctaagcctgctccagccacactgttctcctggctgttcctttttttttttttttttttttttttttgagtctcactctcacccaggctggagtgcagtgcctctatcttggctcactgcaacctccgcctgccgggttcaagagattctcctgcatcagcctcccaagtaggtggaattacaggtgtgcaccaccacacccggctaatttttgtattttgcatagagatgggggtctccctatgttgcccaggctggtcttgaactcctgggctcaagtgatcctcccatctcggcctcccaaaatgctgggattacaggtgggagccgcgcccaggtggatttttgtctgactctgttcattcctgtgtccccagtacctggaaggacgccaagcacacagtaggcgcttaaaaaacattgagccacatgttgagaaaagaacggcaccattgtggctgcaagtgggacttgggccgcgcgggggagctcgcgcacctcgggccggggcaagagctcagtggaacccgcccgaggaagaacccgtggcgcaggattttcccaggccttctgaggaccaggggcgtcccccgtcccaccctgtgactttgctcaggccgttccggggcgggaattcagaactcctcagccccccaagaaaaaaatatccccgtggaaattccttgggaatgaccgaggcgggggaaatatgcgtctctggatggccagtgactcgcagcccccttccccgataggaagggcctgcgcgtccggggacccttcgcttccccttctgctgcgcgacctccctggcccctcggagatctccatggcgacgccgcgcgcgccccacaacaggaaagccttaggcggcgcggcttggtgctcggagacttaagagtacccagcctcgacgtggtggatgtcgagtcttggggtcacacgcacaggcggtggccaagcaaacacccgctcatatttagtgcatgagcctgggttcgagttgccggagcctcgcgcgtagggcaggggttcgagcgccccttctccctgcctcgcctctgcgcctgggggctgctgcctcagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgcggccaaggccgaaaggggaagcgaggaggccgccggggtgagtgccctcgggtgtagagagaggacgccgatttccccggacgtggtgagaccgcgcttcgtcactcccacggttagcggtcgccgggaggtgcctggctctgctctggccgcttctcgagaaatgcccgtgtcagctaggtgtggacgtgacctagggggaggggcatccctcagtggagggagcccggggaggattcctgggcccccacccaggcagggggctcatccactcgattaaagaggcctgcgtaagctggagagggaggacttgagttcggaccccctcgcagcctggagtctcagtttaccgctttgtgaaatggacacaataacagtctccactctccggggaagttggcagtatttaaaagtacttaataaaccgcttagcgcggtgtagaccgtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgagaggtgtgaaccaccgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacgccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcccagctgctcgggaggctgagggaggaaaatcccttaagcccacgaggctgaggttgcagtgaaccaagattgtgccactgcactccagcctgggagacatagcgagattctgtctcaaaaaacaaagcrttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatctgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagacccggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacaaaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgccyggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttcttttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtaggccaggygcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcacttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaaattgattgatgggaggaagggtgaggttggcagagccttgaatgccaggtggaggagctgggactttccttcttggggtgatagggagtcatggagggtttstgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttttgagacagagtctcactctgtcgcccaggcaggagtgcagtggtkcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgctttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatrttggccaggctggtcttgaactcctgacctcaggtgatccgcctgcctcggccccccaaagtgttgggattacaggcgtgagccaccacacgcagcctttttgttattagactctgtcattactgacttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttaatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagcccagccactgggccygagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttycagagacggggtctygcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggycataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtakccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccscaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttgggggtggggggtgtcaaagcttggggcccggaagcggagtcaaaagcatcaccctcggtcccttgttctcgcgtggatgtcagggccyccacccaccgagcagaaggcggactcaggggcgctccagggtggctcgagctcacacacgctgagtagacacgtgcccgctgcaccctgggtaaatacagacccggagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctstgctgtgcaccatggtccacggactggcatcttccccactcgcggtccgcgaagactccatctctccaactaccctgactcagaggcgctgttcccgctccacccagagccctggcaaccgggtccctcagctgttcccgcggttccttccatgagcccagccttgcgtcccggctccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcaggacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtggcccgaggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagggtgcayttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagacgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgctttgcagcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaatgtgagtgggggcagcaccggatggaggggacacggtcctcggaagaatgactcgcagcggtgggagcattcaagggcacctctcccaatcccattctcggggacagggaattccagcctaaaccagggggtaatgaaaattctagccaggcgcagtggctcaggtctgtaatcccaacactttggaaggttgaggcggatgaatcacttgaggccaggagttcgagaccagcccggccaacatggcgaaaacccgtctctacaaaaattagccggtcgtggtggtgggcgcctgtggtcccagctacttgggaggctgaggcaggagaatcgcttgagcctgggaggcagaggttgcagggagccgagatcccgccactgcactccagcctgggcaacagagtgagactctttcttagaaaaacagaaaaagaaaattatagggaataggagcacggccctcctcaaatcctggattagaacactgacctgggcttcacctccttccattcggtgaagaagggcgaggaattttagccgcaacagcagcctgattgtcggggaaggaggctctgataggaggcaggatcctcttctgcccatcagaggcgcggtggtctcccatcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcasccaccaacgcgcacgggcgccacgcgcggcgcatcacggtgcgcgtggccggtaagtggcagctggggagaggcggggcgaggtatctgagagggggcgtgacctgggtcttggggcggccggccccgcctgcctccctctcggtcccggkagactagacggaagtgggacagagtagaagtcaaaggtgccttagcgggtggggctgttgatcgcactttgaggggtgggagatggaggtggcagggggactgaattcaaggggagggaccctccggggctgtcactgctgcaggaaaggactttaaaacttgggctggattctgcgtggtggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggtcctcattttttgggggatggggagagttgacttgtcgccagggggctaagtgtggtcacgggtttatatccccatgggctgaagtgcgatataaatcgggactcgggtcgccctggcactgggagtggccttattgcatgggttgtctcccttctcccaaggccagacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccsaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaaggaactccctgtctccgcttctgtttctgcaaggtggaacaagcccagggttccagtcgtgacctcccgagttattcattcaaaaagcgatttttgagagggcctggggtggtggcttaggcctgtaatcccaggacttgtgggaggcccaggtgggaggatcccttgcacccaagagtttcagaccagcctgggcaacatagggagaccctacaaaaaatatttttcaaaaattagccaaggccggtcgcggtggctcatgcgtgtaatcccaggactttggaaggccgaggcggccagatcacgaggtcgaggtcatgagatcgagaccatcctggccaatatggtgaaaccctgtctctactaaaaatacaaaaattagctgggcatggtggtgcgcgcctgtagtcccagctattcgggaggctgaggcaggagaatcgctttaaccccggaggcagaggttgcagtgagccgagatcgtgccactgaactccagcctggcgacagagcgagattccgtcttaaaaaaaaaaccaggcgtggtggctcacgcctgtaatcccagcactttgggaggccgaggcgggcggatcacgaggtcgggagatcgagaccatcctcgctaacacggtgaaaccccgtctctactaaaaatacaaaaaaaaaaaaaaaaaaaaaattagccgagcgtggtggcgggcgcctgtagtcccagctactcaggaggctgaggcaggagaatggcatgaacccggggagcagagcttgcagtgagccgagatcgcgccactgcactccaccctggcagacagcaagactccgtctcaaaaaaaaaaaaaaaaattagccagggccgagcacagtactctcgcttgaatcccagaactttgggaaactaaggcggggggggggggtcacttgaggtcaggagttcgagaccaccctggccaacgtggtgaaacaccttctctaccaaaaatacaaaaaaattaaggccgggtgaagtggctcacgtctgtaatcccagcactttgcgaggctgaggcgggcggatcatggggttagaagatcaagactgtcctggctaacatggtgaaaccccgtcactactaaaaacacaaaaattagccgggcgtggtggcacatgcctgtagtcccagctactcaagaggctgaggcaggagaatcgctttaaccccggaggcagaggttgcagtgagccaagatcgcaccactgcactccagcctgggcaatagagcgagactctgtctcaaaaaaaaaccaaaaacaaaaacaaaaaaatacaaaaatttagctgggctgtagtggcacacgccctgtaatcccagctactcgtgaggctgaggcaggagaattgctagaacccgggaggtagagatcttgccattgcactccagcctgggcaacagaactagactctgtctcaaaaaaaaaaaaaaaaaaaaaaaagtgttttttgagggggctgggcatggtggctcaagcctgtaatcccaggacttttgggaggcccaggtgggaggatcccttgtgcccacgagtttcagaccagcctgggcaacatagcgagaccctacaaaaaaacatgtttcaaaaaaaaatttttttttttgagatggagtctcgctctgtcgcccaggctggacagcagtggcactatctctgctcactgcaagctccgtctcccgggttcatgccattctcctgcctcagcctcccaagtagctgggattacaggcgcctgccaccacacccagctaatttttttttgtatttttagtagagatgggatttcaccgtgttcgccaggatggtctctattcctgacctcgagatccacccgcctcagcctcccaaagtgctgggattacaggcgtgagccaccgcgcccggcctcaaaaaaaaaattttttttttgagatggagtcttgctctgtcacccaggctggagtgctgtggtgtgatcttggctcactgcaacctctgcctcctgggttcaagcaattcccctgccttggcttcccaaatagctgggactataggcatgcaccaccacacccagctaatttttgtatttttagtagagacagggtttcaccatgttggccaggctggtctcgaactcctgacctaaggtgatccacctgcctcggtctcccaaagtgctgggattacagctgtaagccaccatgcctggtgtatttttcaaaaattagccagacatggtggtgcatgcctgtagtcccagctacttgggaggctgaggcaggaggatcctttgagcctaggaggtcaaagccacttccagctatgatatygtcattgtgctccagcccaggtgacagaaccagaccctgtctctaaaaacaaacaacgaaaaaatccaaaaactttttttgaacacctactatgcatcaggcacaatctaagctgtctttttctttttcttttttttttttttttgagacggagtctctctgtcgcccaggctggagtgcagtggtgtaatctcagctcactgcaagctctgcctcccacgttcaagcgattttcctgcctcagcctcctgagtagctgggattacaggcgcgcgccaccactacgcccggctaatttttgtatttttagtagagacagggtttcaccatgttggtcaggctagtctggaactactgacctcgtgattcacctgcctcggtctcccaacgtgctggaattacaagcctgagccactgtgcctggcccggctggctgtcttttctcagtgtgacctagagctcgtcctctctcagtgcctgttttctgctctcttcacacccttgggcaggggtgggggcctcactccttcctcctacttatctcttccacccagcactgccctctgatccgggtcactcttggaggtgggggctaggtgcttcccccaggcctggttaccggcagagctgaggccgccttgccagggtgggtggaggccctctccgttgtgcccctgccctgagacttcggtgagaccttcctgggcaggcactggctgatgctatgggtgtcagcccttagcatgtcctccctgttaaagggggcacccctgccccgccctcaatgcctcctttgtcctgtgtccacccacagtgcttcagtttacccccaccctgcctttccactcagcccatcatgattcagaacagacacacacagggtatccgctgcaacccccactacacggcaccttcccccctcatccccaacagcataaggcacagcagctgggcctcctccccacagcctcctcctctgcccctcctccctcaaaagcaggaacacggagccctagagaaggaagccagtcccatgcaaacatgtaatgagcaaagatgagacggggaaatggcacaagagggcaggccagtgctcggtgctggagccaggggccaggtataacacccaaaaaggcaccagccaggtgcagtccctgccactaacagcacctcaccttttctgcctgtgccctccctacttaatgatctctctccgctcctactgacctcaaggtctctttcagagccttcagatgagatatttattttagtaggttggtgcaaaagtaattgctgtttttgccattgaaagtaatggcaggcagggcatggtggctcacgcctgtaatcccagcactttgggaggccgaggtgggcagatcacgaggtcaggagttcaagaccagcctggctaacatggtgaaaccctgtctctactaacaatacaaaaaaaattagccggacatggtggcacacccctgtagtctcagctacttgggaggctgaggcaggagaactgcttgaaccctgaagcggaggctgcagtgagctgaaatcacgccactgcactccagcctgggccacagagtgagactgtctcagaggaaaaaaaaaaaaaaaaagtaatggcaaaaactgcaattactttttctttttctttctgtttttttttttgtttgtttgtttgtttgtttgtttgtttgagacggagtctcactgtgtggcccaggctggagtgcagtggcgcaatcttggcttactgcagcctccgcctcccaggttcaagtgattctctcctgcctcagcctcccaataggattacaggcacccaccactatgcctggctaatttttgtatctttagcagagatggggtttcaccatgtttgccaggctggtctcgaactcctgatccacccacctcagcttcccaaagtgctgggattacaggcaggcatgagccatggtgcccgacatttttttttttttttctttttttttttgagacagagtctcactttgtcacccaggctggagtgcaaaggcaagatctcactgcagcctctgcctcctgggttaaagcgattctcccaccttagccccctgagtaggtgagattacaggcacatgccaccacacctgcctaatttttgtatttttaatagagagggggtttcaccattttgtccacgctggtctcgaactcctgacctcaagggattcgcccacctcagcctcccaaagtgctgggattacaggcatgagccaccacgcccgacctccttaactcttttatttccttgcacactttttctctgtagcccagctcacaacttaacatcctcttagacatacacctgaggttttttttttttttttttttgagagggagtctctctctgtcacccaggatggaatgcagtggtgtgctctcagctcactgcaaccttgcaaccactgcctcccaggttcaagcaattctcctgcctcagcctcccgagtagctgggactacagacacatgccgccacacctggctgattttttgttttttagtagagacagggtttcaccgtgttgcccaggctggtctcaaactcctgagttcaggcagtccgcctgccttagccttccaaaatgctgggattacaggcatgaggcaccgcgtcctgcctctgagttttttttttttttttttttttactgtctcctagaacatcagccccagtagagcagggatctttgttctgttcaccactgagggtcctcattgggtcctagcacacacagttgctcaataaatgttgaataagtgggtaaagacagccacgagcttgcagatatgtgttcaaggtgtgtccttgcagagagcttctctatacttggcactggagaggcctgtcgtgggcaaggacatagatgtggcgacctcagacttgagaactcctggggcagtaggggagatggatgtggataatgtaaccataagccttcctttctattttagactgagtggtcaaggaaggcttccagacaatggaaattctgataggttctaagagggagaccagcaaggagctgaaccggaggctgacacagggtgagagtgggaatgtctattttattttttttttggagacagggtctcactctgttgctcaggcagcagtgcagtggcacgatcgtggctcactgcagcttcaacttcccagactcaagtgatcctcccacctcagcctcccaagcagctgggaatataggtgcatgccaccacatccggctaatttttgtatttttggtagaaacggggtttcaccatgttgcccaggctggtcttgaactcctgggttcaagtgatcttgctgccttgggctcccaaagtgcttggattacaggtgtgagcctgtgagccacatctggcctattttattttttaattagttttttgtttttgtttttgttttgagatggagtctctgtctccaaggctggagtgcagtggcacgatctcggctcactgtaacctccacctcccaagtagctgggattacaggcacatgccaccacgcctggctaatttttgtatctttagtagagacagggtttccccatgttggccaggctggtctcgaactcctgacctccggtgatccacctgcctcagtttcccaaagtgctgggattataggaatgagccactctgcctggctgggcatgtgtcttgtttttttcattctgtagataacaagcaattgtcctccctcagcctcccaagtagctggtactacaggcgcctgccactacgcccggctattttttgtagttttagcagaggtggggtttcaccatgttaaccagtctctaactcctgacctcaggtgatcctcctgccttggcctcccaaagtgctggaattacaggtgtgagccaccaagcccagcctcaaactcctgagtttaagtgatcctcacacctcagcctccctgagtgctgggattacaggtgtgagccaccacacccggcctgagtcgggggaggtgtctattttagtctgagtggtcaaggaaggcttctctgaagagctgatgttggggccaggcctcctcaagcgattagaaggtgtcagccatggggagatgtggagggagggtgtttcaggccaaggaagggtaagatcaaataattcagggatctgagggcagaggaatctggactccagttctcccattcagggctgcccaggagagacaaagaggatctcataagggtgtgtggctttgtggctcactcacgcccacagcaaggaccatgcccaccctacttttttttttttccccaagtctccctctattacccaggctggagtacagtggtacgatcacggttcactgcagtcttgacctccagggctcaagtgatcctcccacctcagtgtcctgagtagctggcactacaggcatgcaccaccacccctggctcattttttgattttttggtagagacggggtctcactgtgttacccaggctggtctcaaactcctgggctcaagcgatcctcccacctctgccttctgaagtgttgggattacaggtgtgagccaccatgcccagcccgccaccagtcttgactctccatcctccctccctccctgtgagtgctggtggcctgtgtgtcccgcctgctgaaagatgcctctgacttggggcttttgacttcaggcccgggagacacattttggctggattagggagatcttaaaagggggtaggggacacagcaggggctaaggagagtgacacactgcaggcaggggttgggtgacagatgaaggatccactggtatatgctgccagtgtgtgccatctacttgtgtgttttacgtgtgtctggtgcatgtgtcctgtgtgggctgtatctgtgtgtgactcagctacgtgtcagcatatccctgtcgacgtgtgtctctgctgatgtgtctgtcagcacgcacggctgtcttgcatgtgtcttttttgagatagagtctcgctctgtcacccaggctggagtgcagtggcacgatcttggctcattgcaacctcaacctcccaggttcaagcgattctcctgcctgagcctcccaagtagctcggattacaggcacatgctaccacgcctggctaatttttgcatatttagtagagacggggtttcatcatgttggccaggctggtctcgatctcctgacctcaggtgatccacctgcatcagcctcccaaagtgctgggattacagaaatgagccactgtgcctggctagacatgtgtctttttttttcccttctgtatataacagggtctcactatgttgcccaggctggtctcaaactcgtggcctcaagcaatcctcctgcctcagcctcccaaagtgttgggattacaggcgtgagccactgcacccggcttgtgtgtgtctttctgtatctgttgtgtgtgtctgtgggtagtggctgtttccctgcatgggacattgtggtaaatgtggctaattccctgtgtgggggctgctgcctgtggataagactgtgtctctgtgcatgcgcacgtgtgtgcacgcccctcacaaccccaacgagaaaacacctgtccaccttcctgggctggcacaggggcacaggaggcgggatcccaaatcacaggctttttctctcggcatatctctgtactttattgtccctgctgtaacaatgctcatccttcctgagagcgtctcctgagggggcctcggccaaggctgactggagaaggggctggtgacccctagcaggctctgccacctgaggcctgggtcttcccccgggatccttgaatctggagatggcagagaggaggcaggccggctctttccccaatcctcctaggagagctgcttctgcccattctcccactggtgaaacggaggcagaagcagcagctcagcagggtgaagctgggtttaaccttcctgaayggggtccagggacactccacatctgccacatagcctcttgggctggacatttttcctgggcaccagccagcagctggagcagcgagtgccgtatttcttgtacctagggttgggggacaagaaactgccatttaggatgcagtgggggcccggaaaccgccacaaggaaaccacttttcccaagaggtaggtgttttgctttttgctttccccacaggccatcctggttacacgtggactgatttggggacccccgccccaactccctcctccattctaaggacctgatcccacaggcgttgcagagaggggtcccatcttcagcgtctctccagagcggggtcctctgggtccgacaggaagcacagcgccggggctctgaagggtcagaggtcaaagggcaggggtcagaggccaagcatgtgagctcgggatgcctgtgcggagtcgggcattttgtgggggtctcagtaaaggccccacctagctctggatcagccctgggagttgccagctctaagccacagcaaagccaggaagggagacagatggcagcattccgcagaggaggaagctgggggtgggggtgactcagcccaagtggaggggggtgctgcgactcctccctgagggctctaaatggggaagcaagatggagaaggggggggcagggagaaaggcagggaagacaggaaattggcccccaaaatatttatagctcttgggttttcaggactcacccagggcctcgctgcctgctgagtgggcctcggtgcctcctgggtgggctgcagggcccccaacagcatctgcaggggattcctgagaacggctactgcagggcaggctgtggggcagacaaggtattagcactgggggggatctgtagcttgtccccaacagccctccgaaatgaagatttagtatcaaggtatcagccatcccccgaggaggcaactaatatctgaatggcctggctttgcctctcattagtaatattattattattattattattatttttgcagatggagtctcgctctgttgcccaggctggagtgtagtggtgtcatctcagctcactacaacctccacctcccgggttcaagcaattcttgagcctcagcctcccaagcagctgggactacaggcgcgcgacaccacgcccagctaatttttgtatttttagtacagacggggtttcaccatgttggccaggctggtctcgaactcctgacctcaagtgatccacccacctcggcctcccaaagtgcagggattacaggcatgagctaccgtgcccgacctaattattattattattatttgaaaaatagtaagcacagggacagcctgccaggttccaatcccagttctccatgtccttgctgtgtgagcctggacacattatctcctactctgtgcctcagtttcctcatctgtaaaatgggcttcccaatacaacagtttttttttctttgaaaatttgatttattgatttttaaaaagagatgggagtctgggcaatatagggagaccccgtctctacaaacaaaaaaaatagccaggagtggtggtacaggcctgcactcccagctagttgggaggctgaggagggaggatggcttgggcctgggaggtccaggctgcagtgagccatgattgcgccactgcactccaccctgggtgacagagcaagaccctgtctcaaaaacaaacaaacaaacaaaagcaaaaaaaagcagccaggcatggtggcggctcactcctgtaatcccaacactttgggagggcaaggcagatggatcacctgaggtcaagagatcgagaccatcccggccaacatggcaaaaccccatctctactaaaaatacaaaaattagccaggcgtggtagcaggcacctgtaatcccagctactccagaggctgaggcaggagaatcgtttgaatccgggaggcagaggttgcagtgagccgagattgtgtcattgcactccagcctgaacgacagagtgcaactccatctcaaaaaaaaaaaaaaatattgttttggcggcatgattaaaaaagtcataattataatttttataataacaataaataggtaaaaattagagctgggggtcatactatgttgcccaggctggtcttgaactcctgggctcatgcaatcctcccaccttggcctcccaaagtgctgggattacaggtgtgagccaccaggcccagcttcccaaagcttttttttttttttttttaaggggatggagtcttgctctgtcacccaggctggagtgcagtggtgccatctctgctcagtgcaacctccacctcctgggttcaagcgattctcctgcctcagcctcccaagtagctgggattacaggtgcccattaccattcccagctagttttttttttttttttgagactgagtcccactctgtggctcaggctggagtgaggtggcgctatctctgcttactgaagacttcacctcctgagttcaagcgattctcctgcctcagcctcctgagcagctgggattacaggcacccactacaacgcccagctaattttttgtatttttagtagacatggggtttcactatgttggccaggctgatctcaaactcctgacttcaggtgatctgctcgccttggcctcccaaagtgatgggattataggcgtgagccactgtgcccggcctccccaggcttttgaatgagcccatacacataaaatactgcctgttaacctcttattgttgtcactaccaacaaatagtagctgttagcattattgggaaaaatcaccgcagccgcagctgcagcctaagcaaggccaggcctgattcctaaagagaccaggtctcacattgggagtggggagccactgagtcaggagcggcaggactgtatctggcaccagctcaagttgtcaaccagagactgggccacgtgtaacgtagagcacaggtgagggtccacaccgacgccagrgagcacccctacctcccacactggtgtttgcgttgtaactgggagaaagggcggcctggccccagccggcccctacctgtacgtggggatgatctgcaggctggagtccggctttatctgaaacttcagagtcaccccctcgaacccagggtccactctctcggtgccccggcaggggttcagctgtttccggggccttctctggggtggggccgagggagtccccgggggctgcagacggcggcccttttggctgatcctggtctgtgtgtccttggaatccctgtccagcagcaggcggccctgagtccccagagccatcgggtcccagcaaggccccaggacyggggtgtcctgggcaggggactgacccagcctctccactgtctcttggaggaagcacagggcggtgaccgactcctggcatgcaggccagagggacctggggagaagggcagtggggtcacgttttcttgggtgactcctgggtttagccggccagggggttccaacttgggccggctctttgtgtacccttggacaggctacacaccccacctgaggttcagtcatttctaactctgggtggaaggtttaagagttgcagtaattgcaactcacctcgcccactgtgggcctcccaggcacgcccagccctccacatcaatcaaccccttacggcacccgtagatcacccaggcagggaccgccctaggtgaccgaggcaggatatcaagcctctggctgcaggatcgagaaaaaggttactttttttctttgtgtttcttttagagaccgagcctcactctgtacccccgcctggagtgcaggggcgtgatcaggactcagtgcagcctagaactcctgggctcgaccgatccttccgcctcagcctcccgagtagctgggacttacaggcacgcgccaccacgccgctggcttgccataatatgattacgatttttatcattttcattattattgagttgccctccataacccctggatgatccctggggagtgcctacatcagccccagagacatggaattgcatggcctctgatccctagatgaccccaagtgtctctgggcaccagaacctctttgtaagtttcagtaactattataaaattgccacttctcgataaccccagcaaagagaggtcatgaccccttgatcactgagccaggtggtgaagtgctagcggggtccggggaatggggtttggccttacgcacctctcactgattctgcagcatcctggggtcctcggcttctcctgggagggggatcctcccagccgctccaggttcagacagggcggcgccagaagctttgctggcattgaggagtccgggattggctcggcctccattgcgccccagcccagccccctccctaatttcacccggccctgtcccgctgggcccacccgatgaaacccacctgggaggggcgggacctgtgtggtgggagcgctcttggtagaggatgcgatgagccccagctgagagcgaccagcctcggcggcacctttcctctttctggcttttttcaggtcatccgcgcacccctgcgtggcaagggcggcctggaccccaccaaatccctccgcagctgccggggcggggccttccacgctagccctccccctcggaaatgggggctcccaggcctctgccttggatccccagcggcatcttagatcccagagggaaaagagaaccgggggcccagcacagcagatgcaggtgtggtttgtttttgtttttgttttttttttttttgagacagggcctcactctgtcacccaggctggagtggaatggcctgatcaccgctccactgcagcctaaatcccctgggctcaagtgatcctcccacctcagtctcccgagtagctgggactacaggcacttaccaccactccacgctaatttttactgtttttatagagacgaggtctcgccatgttgcccaggatggtcttaagctcctggcctcaagtgatcctcccatcttggcttcccaaagtgctaggattacaggtgtgagccacctgtagaccccagatctgtcccccaaggacactcaacatgctggggcctgtgttatcgatttattgcagctccaatatgagtccactcctactcaaaccctgattctcaggggcctggggaaggccaccccactaggggccctgtccccaccagagcctggacatgggactctctcccaagcaggggtgttgtccttcacaggggcttccacgtctctcccgggcctgtccgcactctgggcagggctggcacctggctattccctcaatctgggccctggggccatggcaatgtggaatggtccaggtgttcatgtcagtggggcttggggacatggccatccacgtagaagttcctggtgatcttgggcagggtgaattccgctccttccagctccggtgtcagcacaatctggcagcccagccgcgagttctcctggaggaggggggccatgtctagcatgtcgtcttccctagggtggtgacacgggcagtgttagccgagggcaagctagctgggtgggtggggggccagaggtsggggagggaggaagctgactgagcgcagggggtagtggtgggggaggcagctcccattccaggaactggaagtggggaggatggtgggggctgctgaatgctccagggtgaagctgccagctagacagggctgacccactcacctctcctcgggaggaggcaggagatccaggtggtcttcactcacatacacatggcaggtggagcaggccagggaggcttcacaggcccctaggggtgggaagtgaagggggcgcaggtgagtggcagagtcaggaaggggctgctatgcgaatggcgtagaggagtagacctctcttccaccacgtgcctcacgtctccctcctgggcctgcagctccactgtgtgtaccaggcactgtgtcatgtcctcaatgtcctcagctagctgttccccagtgtgtagggtttacaaacggacatctgggaggccccatttcccagggactccctagcaggctgagatgcagaaccattaaggagcagggacttggctgccaggtagctgagaggggaaaggccaggcaggctccccgcagtctgtgagcccttgctgtgaccctatcactgtgctgggctaatgtgtccccacctctccactgctcttggaggatggaccggctgactcagcagtcagtgtggtgggggaaggaatcaggcattaggattttgttttttttttttttgagatggagtcttgttctgttgcccaggctggagtgcagtggcacgatctcggctcactgcaagctctgcctcccgggttcacgccattctcctgcctcagcctcccaagtagctgggactacaggtgcctgccaccacgcctggctaatttttttatatttttttagtagagctggggtttcaccatgttagccaggatggtcttgatctcctgacctcatgatctgcccgcctcagcttcccaaagtgctgggattacaggcgtaagccactgcacccggccaggattttttttttttttttttgagacagggtctcactctgttgcccagcctggagtgccatggctcagtcatagcttactgcctcaacctcccggctcaagcgatcctcccaccccagcctcccgagtagctgggactacatgtgcgcaccaccacacctggctaatttttttttttttttttttttgaggtggagtttcgctctctttgcccaggctggagtgcaatggtatgatctcggctcaatgcaacctctgcctcccaggttcaagtgattctcctgcctcagcctcccaagtagctgggattacaggtgcccaccatcacgcccagctaattttgtatttttagtagagatggggttttgccatgctggccaggctggtcttgaactcctgacctcaggtgatccacctatctcggcctccctaagtgctgggattacaggtgtgagccaccgcacctggccatattttttttttttttttttttttttgtagagacgaggttcaccatgtggcccaggctggtctcaaactcctaagctcaagcaatctgcctgccttggcttcccaaaatgctgggactacaggcatatgccactgcaccagaccaggaattagggttgaaagagacagaacctgaagttttctgctgaccacctgcccttggtcacacccccacatcctctgatcacagagaccggtgcttggggatcatgtccctcctggcctaaaactttccaaagggttttcacactcagaataaaatccaaactccttcacttagtcttgcagttcccccatccccctcattcattcctttgttttcctttgtaatttttttcttagagatggagtcccgctctgttgcccaggctggactgcagtggcgtgatctcggctcactacaagctccgcttcccggattcacgccattctcctgcctccgcctcccagagcagctgggactacaggcgcctgccaccatgcctggctaattttgtttttgtatttttagtagagacagggtttcaccatgttagccaggatggtcttgatctcctgacctcgtgatccgctcgcctcagcctcccaaagtgctgggattacaggcgtgagccaccacaccttgccaggccacttacctctactagcccggcacagtggctcatgtctgtaatcccagcactttgggaggccaaggcaggcagatcaactgtggtcaggagtttgagaccaccctggccaacatggcgaaaccccatctctattaaaaatacaaaaacttagccgggcatggtggcagttgcctgtaatcccagctactcgggaggctaaggcaggagaatcacttgaaccctggaggtagaggttgcagtaagccaagatcatgccattgcagtccagcctgggtgatagagcgagactctgtctcagataaataaatgaacaaataaatctatctcacattccaatccctgtcctagactattggctgctggattccagaacagaactttaggtaggcctttcataacccctcccaacatatcttcccctttaatgataaaatcaggatccctgatatattcatcccaaaagcaaaccctatatattttcttccagacaacccttcccaagttggtcataattatgtatttacctgtgggattattgtccctattagaccgaaatggatgtgagatgacagaggccttatttgttttgtatattgctgcctgacgcgcagtaggtattcatagaaaggcagcacagattagtggctacaatggactggtgagtctagtattgtcactcacttgcccttagaccaggtctacttaacctggggtttagttgcctcatctataatagggaataacagtctctactactcaagttgtcatgaagattcagtcagtgaatatttattaacatggttaaagacatatatatatatatatatatatttttttttttttttttttttttttttttttttgagacagtctcactctgtcgcccaggctggagtgcagtggcgtgatcttggctcactgcaagctccacctcccgggttcatgccattctcctgcctcagcctcccgagtagctgggactacaggcgcccaccaccacgcccacctaattttttgtatttttattagagacggggtttcaccattttagccaggatggtctctatctcctgacctcgtgatccgcccgcctcggcctcccaaagtgctgggattacaggcgtgagccaccgcgcctggccttttttttttgtttgtttgagacagagtcccgctctgtcatgcagcctggagtgcagtggtgccatcttggctcactgcaacctctgcctcccaagttcaagtgattcttgtgcctcagcctcccaagtagctgggattatatgcatgtgccaccacgcccagctaatttttgtgtttcttgtagagacagggtttcgccatgttggccagactagtctcaaactcctgtcctcaagtgagtcgcctgcctcggcctcccaaagtgttgggattacaggcatgagccactgygcctggacaagaaatttctattattatttttctctcaacaaattatcaaacatctgttacatcttgacaggcaacagataagcatgaataaggacatgggtcaccaatctcactgggggacagatgacaaagtaggaaacaaaacagcctggcattgtggcttgtgcctataatcccagctacttgggaggctgaggtgggaggatcacttgaacccaggagttcaaggctgcagtgaggtatgattgcatcatggcactccagcattggcgacacagcaaggctccgtctcttgaaaaaaaaaaagtgagaagtgctatatatcatatcacactgataagacagagtaactagggcatgggtacttcagctgggctgaggggaatgggattgttagggacatgacatttacactgaggtctgaaggatgagaaagagccagaatgtttgctgggaaagcacttcagacagagggaacagcaaatgtaaaggccccgaagcaggaatgagcttggttgtttgaggaaccacaagaaagccagtgtgggctgggcgcggtggctcatgcctgtaatcccagcattttgggaggctgaggcgggtggatcacctttcaggagtttgagaccagcctggccaatgtggtgaaaccccgtctctactaaaaatacaaaaattagctgggcttggtggtgggcgcctgtaatcccagctagtctggaggctggggcaggagaaacgcttgaacccgggaggtggaggttgcagtgagctgaggtgcagtaagccattgcactccagcctgggcaacaagagtgaaactccatctcaaaacaacaacaacaaaaagaaagccaatgtggctagaatacagggaggaagggggaagagaacacaaaatcctgggagccaggagtcctagtgatctctaataaatgcttaacaaataagagcttggcaacagatgaggccatggtgaggggtttggattttagtccatatttggtgggaaaaagacgtgaagagacacacctratttgtggktttttttttttttttttttggacaaatgtataaggacctccttaattccctctgcccggttcctaccttccaggtccaccccgtggcgctgggccaggtgaagaacattgtccccgactctgccactcactgggatccgctggcctgagcggtctacgaacaccacgttcaccctggggacagatggaagtgcgaatgccgaactggatgatgggctcagggcccgggtagaatctagggttaggaagtaggaattgaggcttgacgcacaggtactgaatagggcaaagcagaagggggacctcgagatgaagctacagggcaagatggggaccagaggaattccgtgggatgaggaatgggggacttggccccctgcactcacacgtccccgggccgctccgggccgcccgcgtcctcctctccmgccgggcgcgagcctggaaaacacggttcggtgagcggctgcgccgagccccgccccgccggcatctgacggattaacgctgcccgccccgggcgccccaggtacctgtcgcttgaaactttctggttgtccccagcgccaccccctcccccgacccggaagtgcccccaggtctgttccaccaggtgcccctggcagcctgcagtagaaccctggcactcacgcctccccgggccatggaggcggccatgacatgcatcacgtgactcaccgactgagcatgcgccgcgccagggaggcgagggaaagcccataatcaatggaacataagcgcagatgtttgcttagggcctgcggtgaccaggtgggaagagcagggcggaatccatctcaggtaaacccgcggggccatcccagacctcccactcaagcccactgtttgtcccaagaaccagccaactctgatttctttaaaaccatttacttacaaactttaattcagcaaaggtccgtgtggggagactggggtggggtcgggggaatagtccccttggagtggatgtggacccccagagtcaagggagggaagctggtggcccagttggctgggggcaaggcccagggtcacctcaggtcgacaggtcctgctggtgggcgggcccagagtttatcttcatggagtgctggtttctggcactgggctggaaggaggccagctccagggatctggccgggggtgggcaggcagaattcaagaattcatcttcaacaagcgagtgacagcagaggctccgggagatgggcacaatgtccgactcccacakacagacagcaggggactggcagagaaagcccatctctgcacggaggcccgggtaggagggggtggtggggccggttcgccaagatgaaggctttccccttctactgtccccagggtggagatcctgggtagggtggcccaatccctaggccagagctgtttggtccatagtcaagctcccagagcttggcatctgtggctctggccagcagggcctggggcccagcttttaaggcatcagaaggggagggggctgcggcagggaccccgggccccacggctggggtataggccagatgggcaggcaggggcaggagacagccatgcctgcagcaaatgtgggaaaaacagctgtttcaaaccgcaaggtgtggaatggtggcccggacaggccgggccttgaaggaatcagagctgggggctgtccggggtggtttgaaaaataaaacttagaaaaggaaacagaagtcagttgtcaaagttaaaaaaaaaggagacagtctctgtatcttcacgggaggtcagggaaacctccaaggcactcgaaaggccaaaattacaggagcaatgaggcaggagggctccggagagacgggcacagcggaggaggagatggggggagggagggagagcaggccggggcccctctctcttaaggctgcagggtttcagcgtggggagcaagccagagacataatgaggcctccagactcccccacaccccttgggctcctggggctccggctgattggtcagtaaagtctttcagagatttttctattaccgaaagagagaaaatggtttaaaaaaaacacaaaacaaaacatcagaaaacccaaaagcgatttggtgcaggcccttgagttatctctggtgccagccacttagaaaatcctcttccgcttcaggtaggagtccgcgtagtggccgccgaggccctgggagtgctggcccacatagctgccttctgggctgggctcgggcgagggcagcaggtgggcaaagctgcgtttctggccgcccagtggggtctggagacagagggcagggcggggcgggtcaggggccgctggggggccggggcttcccagccctgcatgtccccaccccctgcccgtaccttcagcaggtggctgtgaccattaggcccggggctgaggcccaggagcccttctccggaccccagcggggaagagccgattgcctgggagaaatggagaggtggaacaggtcactccctgggggccagaggaagcacccaccccgcccccctgccactgccccccagccctgagggaaagcgaacagtttcaggttcaaatcttgcttctgctactttctagctataagacctagggccaattgctccattttatttgagcctcggttttctcatctgtcagatggggccagtagcacccacagcctgggctgtagagagaggaagtgacagaaagcccggaatgctggcagtgctaggtgcttgatgcagagtggatggaggacaataggctgttgctactccaccctgagcaagaccaacccctgccaccaccccagctttggcctgggcaccgagggttacagagccccggtggcaggcacccccaaatcctagctgtcccagggggcctgtgcttggccagagaggttcctcaccttactgaggtggctctgcttgaggccagcctgcaggccgctggtgaagtaggaagtgggcgagcctgaatagaagtgagacagggggcccccgccactcccaccgctgctccgttcgccgaagccactgggcgggggggacatctgtagaagaagggccggtggagtgaagcagacaattgtagtacccagccctttgtatacaatcttccctcygcctcccaggttcaagcgattctcctgcctcagcctcccgagtagctgggattacaggcatgcgccaccatgcccagctaattttttgtatttttagtagagacggggtttctccatgttggtcagactggtctcacactcacgacctcaggtgatccgcccacctcggcctcccaaagtgctgggattacaggcgtgagccaccatgcccggcagttctgggctttgcaaagactagctttggctaataggactgaggagagctggcacgtgggtacccgcctcctcttcctcctccaggaacccagggatcatcaccgcacgaatgggcacacagaaactgttccagcctgtggacgccaaatatgtgaggccacatagctcactgagacccaggtgagtgccggggaccgcccactgccccatagagtggcaagaagtaatamaatgcctggcatggtatggtggctcatgcctgtgatcctagcactttgggaggccaaagtgggaggattgcttgagcccaggagtttgaggccacagtgagctatcatggagccactgcactccagcctgggcaacacagtgagatcctgtcttaaaaaaacccacaaagaacacacaaaatacaaggtctgctgttccaggctactaagtcatggcacagcctgtcatgtagtaaaagctgattgctacacatgccataccaggtggctcttaccttgtgtcggctgggtccgtgaggcccaagggctggttcccgtgggtgggagaagagccgccgaggtcccatgtcctgaatgaaagcgggagaagcacattgggttggagtctgtcccagcctcacccctggctgaactccatggcagagctgtcatcagggaagacagtccccaccactctgggaccaggaagaggcaaatttggggctggatgcagcttggcagggatggctgctgtgaaggggggtgccccccatgggcctaagtgtttggagtttcccaggcaagctgggaattcgagctgtgtggactcttgcagttttcctgtgttggcgttagttcctgttgttatttgtttgaaacacagagggggccaaacatcacccaggtgacctgtgggcggccagtttgcaatttctttcttttttttttttaaacggagttttgctcttgttgcccaggctggagtgtaatggcacaatcttggctcaccacaacctccgcctcccaggttcaagtgattctcctgcctcagcctccctagtaactgggattacaggcatgtctaccacacctggctaattttgtatttttagtataaaacataaattatattttatattatatatgaaatatatattttattatatattttataatatataatttctccatgttggtcaggctggtcttgaactcttgacctcaggtgatctgcccgcctcggcctcccaaagtgctgggattataggcatgagccaccgtgcctggcccagtttgcaatttctgacctgccaaggaggttggcatcatagaaggaccaaatctccaggggcacagacaggaatcaaaggtgggagagagggatagaaagggcaagccctgtctctggggagagacagtgtggcctaagtcctcttgggagagaaagacagacgcaggatgacagacagactgagacccaagatcctccagggctcgagaatggacagacaggcaggtggaccggaagcagggggtgatgtgcagacagacgggaaactttaagggcatgaggctgggcgcggtggctcttgcctgtaatcccagtactttgggaggctgaggcgggtggctcacttgaggtcaggagtttgagaccagcctggacaacacaatgagactccgtctctaccacaaatttaaaaattagctgggcatggaggtgcrtgcctgtggtcccagctcctcaggagactgaggtgtgaggatcgcttgagcccaagaggttgaggctgcagtgagctatgatcgcaccactgcactccagccagggcagcagagggagaccctgtctctaaaaaaaaaaaaaaaaaaaagcagagaccatatctggcacgttccctgccgcctccctagcacatggcctggcatagtcaatcctagagaaatatcagtttggagaatgatttggccttaggggacagagagctgcagccaggcactcaccgaggggtagtcgaagctgtagctgtcagacagtcctggttcggggggcaggcgggcgctgctgagggggctgagcaggcgggacttgagctggaaggctttgctgctgctgctgccacctccaggggctggggggttagttggggggccctcagctgggcggcggcttctcccggcgcctccccagccccgggcctccttacccgccaggttgctggccgggagcaggctgtgtaggttcaggtagggattcaggggaatccggtagtccttggggggctcccccagcagtgagacctgtggcgggaaggcaggattcgagagggcccccgggagagggaaccctgcggaacaggaggctggtgtggtgccgcgcgcagggcagggccttaccccagggggcgtcggcagaggcccactgtctttctggaggcctctgaggccagagcctcggagccccacaggggcggggggaggagtgagctgggccgctgggggacccaagcccagggcctcccggtcacccccagcagggccaagcacggatggcagcaggggtggtggcttccctcgccggggcggcagctccgggggcaggccccctcctagggagggaaggaggatttcaggggcccaggctcacaggacccctctccccagggccctccagctcccacctggaccagggcccaggggtcaagagacaaatccatgctggccactgagcagagctcatccctgggccctgagtggagggcacccaactgatggacaagggcgctgggacccagaggttgggtcactcacccgaggccacgtagcagggaaggaaggggaagtggctgggggacaccgtgtgggcagggtctgcgttacctgcaggcagctccccgaggagggggttggctggctgggccccaggctggagggcgcccaggggtgagtctcccaggatgccgggcttctagggacagagcacagacagttgcagatgggggcagggtggcccagggaagcagacaggtgtggcccagagtcttggcagacacaccccaactccagggcacggccgatcctgggcagacaggcacagggttccccagtgcccgccacactccaactctatcactgtcccatcagccatggtgaccgagggtctcctgagctccaggccccagttccctggccaatgattgcagcacagtatcaactgcagccacatggaatgggacagccacacagtgtttcagccacttttagtcacagaaggccagacccacaggctcacatattctgtcagttaccaccagacagacacacctgacttagaatccagggaaccacaccagacaggacggagcatgggtgtatgtctatgtgtgtgtgtgtctgtgtgtgtgtgtgcgtgtatatctgtgtctttgtttctgtgtgcatgagtctgtcttgtgtctatatgtgtgtctgtgtctatgtgtgtgtctttgtcttatgtctttgtgtgtctatgtctctgtgtgtatatttgcatctttgtatgtgtgagtctatatgtatacctgtgtttctaggtgtgcgtgtgtgtgtgygcacacactgaggggatagacctggagttttttcccaggcatgtctatagagcttccgagcagagtctattcacaaactggtgcccagcagcggcgctcccagcccacacccagtttcaggctgtaaatgggcgtgtccaggtcccctgaccccaccccaggcaccaagtccaggggcgctctcagaatggagggaaagatggcgaaccatcatgagcaattgccagagggggatggggatgtgggtgggaaaggcaggggtttgggggagtcgccctcaccctggttctgcgcccccagggcacagccagaggtccccccaccccaccgatcgcaccagctgtgttgaaaagagcctgtaggggctgtagagcagtgggtgagggggatgcgtgtgttaccttctggccctgggtctgcagggcgagctgcaacagcgccgtggacagggctggcccattgagcagcggcatggctgggggggcacccaggaggcctggagggagacataggaggatgtgtgggggtccctgtgtcctccctgccccacctcacgaaacacagccctgaacccattgatggggcaggaaactgacactctggggccggggggtgggcagtggacttgcccaaaggaagggcctagaaggggcagaggctactccagtgaaggtcagccccctcttgtcagcaccccacctcactgcaggctgctgtgtggccctggtcccggcccccagttgtggacagcagcagcccccgctatgactccatactccccctcggccctactcctggggctcctgtcactgcagccaagatgagcagtttcgggaagtgccgggggcagcgctgcagcccctgttctgcacagtggggcccctgtccagccccaccttaccctgcttcccccccgcactgccatggagcagggggttgagcagcagctggagggacgcggatgggcccaggttgttgagcagctgcaggatgttgggctcggggaggagtcccttcccccgattgagggcctgcaggaaggaacagaagcagctcagagtgccgctggggccctgacatccccatggggctcccatccccaccccgccacctctgcccgcacaggctcaccgtggcctgggcagcgatgagagcggccagcatactgcggccggggggcccaggggcgcagaaggagactcgcaggtggctgccccccagggacaggccgtccgcctgctgctgtgcctcctccgccatctcagccgtctcatactccagcaccgcgaagcccttcagctgcccatcctggccgcacgccagctgccggaggaaggcaggcagtcatgagcatctgggcagcagtgactgcaccaccccgggaagtgacaaccgtaaccagactcagctgccccataagggtgaactccacgccaggcctccactgccctgtgcctcattcctgcatcagctcatctgattttcccaatgaccctgggaggctgcatcatacccatttctcagagaaggcaactgaggcacggagaggtcagcgcacccaaggccacacagctggagggagggcggagctgggagccacctcaccaacaaagccaaggccacgggcggatgcggtggctcacacctgtaatcccagcactttgggaggccgaggcgggcagataacctgaggtcgggagttcgagaccagcctgaccaacatggagaaaccccgtctctactaaaaatacaaaattagccaggcgtggtggcacatgcctgtattcccagctacttgggaggctgaggcagaggcaagagagtcacttgaacctgtgaggcagaggttgcggtgggccgagatcgcgccactgcactccagcctgggcaacaagagcaaaactccatctcaaaaaaaaaaaaaaaaaagagataatcagcaacgggtggggaaggaagggctctcgttccagacagtggccaagccaggtagcagtgctaagggaagtggttgggctgggcaccggcacttgctgaatgcccgggcagcaaaggtgcaggtagcagcccttcacctctgcccacgccctgtgccaaggtctgggcacagatctcccataaccaaacctgtcggcttttgttttgttttgttttttttgagacagagtcttgctctgtcaccccggagtgcagtgatgtgaacttagcttaccgtaacctccacctcctgggttcaagtgattctcctgcctcagcctcctggtagctgggattacaggtgtgcaccaccacgcccagctaatttttgtatttttagtagaaatgaggtttcaccatgtcggcaaggctggtcttgaactcctgacctcaagcgatccgcctgccttggcctcccaaagtgctggattacaggcgtgagccactgtgcccggccataaacacacccatcttagggatgaacagagagagactcagaggggtcacagagtgatcaaggccacacaattcctaagtcgagggactgatgtgtgaacctcaagctgcttcactgtcaagcccaccctccattcagcygggtcacctaacattaaaggtgggctcctcggaggacatcacttcaacgcctgctactcatcagatgctcaacaaatgtttggtgagaccaggcccagtggctcgaatctataatcccagctctttgggaggcaaaggcaggaggatcgtttgagcacaggagtttcagaccagcctgggcaacatagggagaccccatcttcacataattttttttttttttgagggagtctcgctctgttgcccaggctggagtgcggtggcatgatcttggctcactgcaacctccacctccctggttcaatcaattctcctgcctcagcttcccgagtagctgggattaaaggcacctaccaccacgcctggctaattttttttctatttttaatagagacagggtttttgttttttgttttgttttttttgagacggagtctcgctctgccacccagactggaatgcagtagtgggatcttggctcaccacaacctctgtctcccaggttcaggtgattcttctgcctcagcctcccaaatagctgggaccacaggcacatgccaccacacccagctaatttttttttttgtatttttaatggagatagggtttcaccatgttagccaggatggcctcgatctccagacctcgtgatgcacccacctcggcctcccaaagtgctgggattacaggcgtgagccaccgtgccatgagacagggttttaccatgttggccaggctggtttcgaactcctgacctcaagtgatctgcccgccgcagcctcccaaagtgctgggattacaggcatgagccactgtgcccggcctctacataaaattttaaaaatcagctgggcatggtgaygcattcctgtagttccccagctacatgggaggccaaggtaggaggatttcttgaacccaggaggtcgaggccggagtgtactcctccagcctgggtgattgagaacctgtctcaaaaaaaaaaaaaattaagtttagtgaatgttcgagtggaggaatgaatgggcagctgttcacaacaacctgatcatgaagcactgccagccccattttgagatgtggaaacaggctaggagagtacctgtagctggtcatgaccctgtgacctttgatctccacataagaaggtaaggccaggccagcgcagtggctcacacctgtaatctcagcacttggggaggccgaggcaggtgtatcacctgaagtcaggagttcaagaccagcctggccaacacggcgaaaccccatctctattaaaaacacaaaaattagctgggtgtggtgtcaggcgctgtcatcccagctactcgggaggctgaagctggagaatcacttgaacccaggaggcggaggatgcagtgagccaagatcgcgcccctgcactccagactgggtgacagagcaagactctgtcttaaaaaaatataaaataaaataaaagaaaggtgaggccattgtgctaactcatcttctgtcctgagcccgcacaggcggcctggtacatagcaggcctggtacgtagcaggtgtccaagagaaagcagcagaatggatgaatgataagtaaacagagagggggttcccgtggctcatggatactcagtttttgttttttttgtttctttgagacggagtctcgctctgtcgcccaggctggagtgcagcggcacgatctccactaaccgcaaccgcagtcttctgggttcaagcaattctcctgtctcagcctcctgagtagctgagattacaggcgcgtggcgccatgcctggctacctttttttttttgttgtatttttagtagagacgggatttctccatgtttgtcaggctggtctcaaactcctgacctcaggtgatccgtccgtctcggcctccaaagagctggcattacaagcgtgagccactgcgcctggcctgtttttttttttttttttttttctgtttttgagatgcagtgttgctttgtcacccaggctggartacagtggcgtgatctcagctcactgcaacctccacctcccaggtacaagcgattctcctgcctcagcctcctgagtagctgggattacaggcctgcaccaccacacctggctaattttttttgtatttttagtagagacagggtttcaccatgttggccaggctggtcttgaactcttgacctcaagtgatccacctgcctcggcctctcaaagtgctgggattacatgcatgagccacctcacccagcctgtttcttgttttaaatatagagatggtgtcccactatcttgcccaggctagtcttgaactcctggtctcgagtgatcctcctgcctctgcctcccaacagacacctagtttaaatggggcaccaataccccacttacacgagagggacccactcaagcccacagagctgggggtccgagcccaggactgtctctctgtttttgagatragggtctagctctgttgctcaggctgtagtgtcatggtgctgtggtgcgatcatggctcactgcagcctcggactcccagaatcaggcaatcctcccacctcagcctcctgagtagctgggactacaggcacaccatcatacctatctaatttttgtatagagaggatttcaccatattgcccaggctggtctcgaactcctgggctcgagggatccgcccgcctcagcctcccaaagtgttagggttacaggtgtgagtcactgcacctggccaggcctaccccttttaagcctctgcactggcctccgctcactggcccaagctctggagctaggctgcggtgttctgatcccagctctgccagaccctggctgtttaactctaggcaagttacttgacccctctgtgccttggtatcctcacctgaaaatgggagtgatacctgcctctcagggttgctacaggatgaagcaactgaaggttacgtactcagagtccacagcgagtgctgggggaatgtcccctttgggatctctggggatcaagaccttctgggggctcttagagagtgagtctggcctgttctcgccccactgcacctgttacagggcgaggcacacacacagaagtgcctggcatgtgtggcttgaatgaacaagggactgttttgccaacccattgtgcaagtattgagtccctgcttatggaggagggaaactgcagatcagagagccagtgactggcccgagctcgagggcggggctgggatctggcaaagcctcagtctctgacctcaaggctcaaatagactgtgggctcctctgcagcctcctcaatgcctggtccaggtctgggaccccatgggaggtttgacgagggtaccagcgaatgaggaggtgagtggtgagcaagcctcgagatccatagttacaagagtggccttgcatgcatctgatagagggacagtgaggcctgaggctgcagagggattcaaatcccctggccaggtgtggtggctcacgcatgtaatcccagcactttgggaggatcacctgaggccaggagttcaagactatcctggccaacatggcaaaaccccatctctactaaaaatataaaaattatccaggcatgggggcggggcgcctataatcccagctactctggaggttaaggcaagagaattgcttgaaccaaagaggcggaggttgcagtgaactgagattgtatcactgcactccagcatgggtgacaaagtgagactgtctcaaaaaaaaaaaagaaaaggcagatgactccaaagactctctcaggtgctccgggcctggcacctgctccccaatgctctccacagggctcacctggcagaaggtggggctgtggacagctgacagcgcccggcacagagcgtccacatcgttgaagccaggtggcaggcggtccacacagaggcagcgggagtggagaagggcaggcgtcagttgcccggcatccgtccagtgcacgtagagggtgcgtggtcccagcggcttgcccagcaggtcygacttggcacgggcagccgagtccttcttcatgtactcagcaaagccatagcccttggattggccagtgcgctcactgtagaccaggaagcagcgctccaggctgccgaagggccgcaccagctcctcgaactgctgctgtgtgaggctggggggcaggttggccacacacagcagggcatccgtgggctgcagctgcaccgacagttcrcgctcccgcaggcggctctggtggaaagcattgattgcggcctcggcctgctccccattcagcagggtcacgaaggctgcggtgggaggagggcagtgcgaggtcagccgggccctgagggcctgcccctccaccccgccaccctgcaaaccaggtgggacctccaaatgctgggcatctcaggtgcctgctgatctgagcagttgccagccttggcgactcacacaggcgagagcgcctgccattgactctaggctccacgaagcccactccctctcccagccctgcgtccacctgcacccacagcagcgctcaccaactgtgggcctggctctgtcctaagaacgctgtgggtcactcgggtgataccaagggcagtggttaagcccatgctcactggggcccagatttaagccccaagccccaggtggctttgggggtatcagtttcctcatctctcaaatggatataacttaatcatcacaatcaccattttgccagagaggaaacgggcccagagcagcacccctgtgccccgagtaggggagcctggacttgaacccaggcagccggactccagaggcccactctacacactgcccacccctgccacctttccaggccaccagtgcccctgaaccctgctgccacgtgctgccccagatttgcgatccacccagcggccgcaggaagctttgttcaaaacgatcacgccacatccatcttgtggcttctagctgcagggtgcagtgcagcctgtgcgggctcgctgacctcccctcccatctcaccgctgccacccggaccacgccaggcacactccagaggggcctttgcagctgctgtttcttgagcatggaacactgagccccacctcctcacctggttaacctggacccacccaggtagaaaccctgtctctactaaaaatacaaaaattagccgggcatggtggcacatgcctgtaatcccagctactcgggaggctgaagcaggggaatgggctgaacccaggaggcggaggttgcagcgagccgagctcgcgccactgcactccagcctggcgacagagcaagactccatctcaaaaaaaaaaaaaaaaagaccacacaagcaggggtgactggctgagtgaggcaagaggggtaagaagagaatgaacccacggccaaacgttgtcaagaattagctcaatgccaagcgagtggagtaggaagagaatcagcccgatgcccagtgttctccaaggagaacatgaaggctgtcccaagatgacaggatgacaggcagattggggcaacctgccatgttggcctggggggcaatactgggcctgaagctcagagcagcagacagtgagccaggccctcccatcttcagggatggtcactccctgccctggcccrccccatggccccacaaacctgtccctttgtatttgtccacaaaacagtatttgagctcatagtcactgagcaggtcatgtacttcctgtggagatacaagacaaaagacagggagttactggagatggaagggggcaacccagtgccgcttcatagctgccaccagctatgaaggcaggtcaattaccaccccccattttaccaatgaggaaactgaggctcgatgcagtaattttgtcaaggtcattctgctcatacctggcagagatgggattcagaacctagctgcagactgtgctattacccaggcaacatgctcttagagggtatacctttagctggctgggcggggtggcycacgcttataatcccagcattttgggaggccgaggcgggtgaatcacctgaggtcaggagttcgagaccagcctggccaacatggtgaaaccttgtctctactaaaaatacaaaaattagccaggagtggtggcgcacacctgtaatcctagctactcgggaggctgaggtaggagaactgcttgcacccaggaggcagaggttgcagtgtgccactgcactccagcctgggtgacaaagggagacactgtcaacaacaataacaacaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaaattagccgggcgcggtggcaggcgcctgtattcccagctactcgggaggctgaggcaggagaatggcgtgaacccgggaagcagagcttgcagtgagccgagattgcgccactgcagtccgcagtccagcctgggcgacagagcgagactccgtctcaaaaaaaaaaaaaaaaaaaaaaaaaaataacaacaacaaaaaaaaaaaaaaaaaaagaggccgggctcacgcctgtaattccagcactttggaggctgaggcaggcgggtcacaagatcaagagatcgagaccatcctggccaggaaggtgaaaccccatctctactaaaaatacaaaaatcagctggctgtggtggcgtgcacctgtagtcctagctactcgggagactgaggcaagacaattgcttgaacccgaggggtgaaggttgcagtgagcagacatcaagccactgcactctagcctggcgacagagtgagactccgtctcaaaaaaaaaaaaaaaaaaaaaaagagtatgcctttagggaagccatttaacctgcatgaacctccttttgcaagattcactgtttccaacaactctgtaagtgaagtattaacaaactcatgttgtatatgagaaaacttaggctaggagaagtgaagagatctgctggaggccatgcagttgggcagcgcagccacccatgggtacctgactggggagcccaccttctagtaagccccacgttgtgtgggttcacatgcctcccaatttcctcctgctgataaagctgccctcttccaagccagctcatttatttttcttttttttagagatagtgtcttgttctgtcacctaggctagagtgtagtagcacaatcatagctcactgcagcctcaacctcctaggctcaagtgatcctcccacctcagcctcctgcgtagctgggactacaggcacgcaccaccatgcctggctaatttttaaaaattttttgtagagatgagggtttcactataccgcccaggctagtctcgaacccttgggctcaatacagcctcttgcctcagcctctcaaagtgctgggattaaagggatgagccaccatgcccagcctctcaagccagctttgaaggcaaagtgctggcgcctgctgggaccagacacactgtgcatcttgcaggagagacaatgtgttcccagctgagagactgcagacactgagaggaagacccagaaagaaacctgaccatccttaatgatccctgtcccgatctgtccccaaattcagcccctcccaacatccctggggttccactagccacgtgcccacccggtgtgctggtgggccggagagcagggaatctcagcagcaggaagcgagaacctatttcaccgccatagggcagggcagtatagatgccatttccctgggtccaaagagcattgggaagcgctgccccatgctggccccatgagaagggcactcctagcaggaagattagccacgaggggctccatagaacacaggcctcgcttccttcctgtaggtctgtaggctggtggcagaagaccccattttcccaaattaatcctgaggttttgggggctgagacccaggggctgctgttaacttccggatttatctctgagagcagtgaataaacgcgtgatatggaggggcgtactctccgcagtcctgaaacttctggatgtgaggtcccgccaccctgtggtagagtgggtggagaaaagcatcatccaagcagggggcaactggtggtccaatgtaccagcccattcacaattccccaacaggaccaaagctgtccgcccccttccattccccgcccgcttccatcacttggtgtcgcccaagcctgtggtcgcccctagcaacgccctccctcacttcgcagtcggtttcccctttcatcatcgcccccccacgtcccgctcttggtctctcccgatcccgcgtggatccggtgcttgggcgcccccgccaacgacccccgcgcacctcagcgttggtgtcgcccggttccccccgcgcacgcgcaccgtggtatttcccgccacgctcctacaccgccccccccaatacctggttggtcacgtcccccgggaggccccggatcagtatcttgcggcggttacggaactggcgctcggtgtgttccaggcgtttccggatctcttctggatctagaggcggcagctcttcttccggcgcccggcgctccgcggcatcgccggcttcgacttcggccccagacttagggctcagcgggggccggtgagtaacggacacgtccgccgccatcttgggaaacccggcgccttctgggaccagcgagccggggcggagcggcatagagcggcaacgagggcgcgcccgtcgattggctgggagaaaccccacctccttcccgccccccttgccccgttggctaagccccagcccacctctcaagagttcaagctgcgtctgcgcgccacaggccccgcccccttccgtcgcagcgacgctactcagtggatgtgcacctgggtgggagagacttgcagcgcgggtggaatcaaaccacagattagggagtttgaaggctttattggtgcggaatctgagggcacagccaagcccccgccaactttgatcccggatcccagcgtcactcagctctggacggttcttcccccattgcttctgtcggctgcatagacgtgaggggcagataggtgstctcctccctaacatggtaactgccgctccgttggtgctccctgaagacgtacattaaggccagtacgatagtcaccacgcccagggtcagtaacaccgccacgaagacggggacaaagtgggagctcccagctgtgcagagaaagcgctaagtcaatatgcgtcccttctgtctccaacccccccgccccccggcttaccggtccagacccgcagccccgtrttagctcaccctcaatgtccatcaccacgaccagggtgtatttgcctcgtgagctggacgcttggcactgataagtaccattatgtgttacgttgacgaagaacgggatccccaccggcacctcccggctggagccttccttcaaacaccgcagctcggggtacgggttgcccctggcttggcactgcaggacgtgtctcgttttatctttccatttcaagtgctgggggcatgtggctcggtcaattttgggaccatctgtggaaccaccatgtgtgatcagacacccaacacacccgaggcacagtggtgcagaggagcgtctaatctttccagggcaggggtggagggattaaaggtcagggtgaccgactcacacaggactcgcagctggacgctactgttcctgtgcaagaactcgccgtccacctcgagagtggcactgcagaagaagctgcgtccgtcgtcactctcggtagcatttagctgaagttgagctggctgccccggggccgcggccggaactccgtccagcgtgacctggactcgagccccagccatgcaactcacggtcactgtggacccctcatgggcggtgggctcgctgaggttcacaatgggtcctaggaagcctaaaggcggggcattgcccaggagcttaatgaacaggaccttcctgtgggtcaagccgctccctccgccctcccctttcctctcgggatatccgggccacgctttcggccgttcaagcctcgccctctttccgcgctgtgtccagcttcgggcactcaggcccaacccacgttgcaactgctattggggcaagccaggccccaccttttcggctagtctccgccccctctgccacgcccccagactgctgaggccgcgcccccttcccacgcctcctcttactaaagaccgtcaagttctcccgggcctcccgtctctcgccccctagggtcacgttgcagacgatctcccgggcaccctcctgatccgcgcgcgccgtggctgtggctgtggccgttagcgtgtccccgtggttcatgactgtcgcattcagcatctggtcccccagcgccaggtagacctgggcctctgaggctggaaaaagcccgtctagggtgcagtccaccggccacgacgtttccacctccaagaaccggggggccacgaggcgcgggggggtcacgggcaggactggggagaaaggtgggcatagtacaacccccaggactgtgccttccccaggacaccctcatcccccccagtcaggatatcttgctgactgggtcacccttcttcacaggacacacacacagggccatgaaaacggccttcttcaaagatcccacggctcgggcctcccttccggggccaccttgcccagtggccgggggctttccttcccagaagcctgtgaggtccggggtaccccactctcaggaaccccaaggtcagggcaccgtctaccctggctcagctcgtcacccaccgtctgaagccccttctctcaccaaaggttcggagctggcggggggctgaggtgttcacgaacagtcccagcccctggggctgcatgtccagttctgtgcggcatgagaaaggggctccgtggtcgtctctgctggccagcacagtggcagtgacctccgctggctcctccactgcgggctgccggctcagctcctcctcccagcgaagcagcaccaccgtgaggctggtccggggcgacccaycctccacttggcagcgcagggtgaagttctggcccaccggctgccaaggaggcaggggtgccagctccacacgctccgggagccctgagagaggaggggaggatggcacttagcgggtcctgcaaacccacccactcaccccagggactggggaggagacagggtrgtcctgccgagaactgtgagctttgagttaataaacttagagggcttagagctgggccagtcgaagcgtttgctattatcattagcgcagtgattatcatttcctgtgttgtcagataccttgcaaggcgctaaacaaaactttctgttctcaaagatggcamaataaaaaaaaatgaggatggaagggatgaacgtttatgactatgatatgaatattaaaaattcctgtttatggccagacgtggtggctcacgcctgtaatcccagagctttgggaggccggggtgggtggatcaaraggtcaggattattcagttctctccaatcaggttcagacactcagggctttcctggttcaccagccctgtggcagcctctcaagatactccggcacagtcacaggagacttgacactcccaggctgggtgccctccccagtacacctacaaaacgctgggcctcaggccgggcactgtggctcatgcctgtaatcccagcactttgggaggccaaggtggacggatcacctgagaccaggagttcaagaccagccttgccaacatggtgaaaccccatctctactaaaaatacaaaaattagccaggcatggtagcacgtgcctgtaatcccagctactcaggaggctgaggcacaagaatcgcttgaacccaggaggcaaaatttgcagtgagctgagatagtgccactgcactccagcctggcgacagagagagactctatgtcaaaaaaaaaaaaaaaaaaaaaaaggctgggcaaggtgactcatgcctgtaatcccaccactttgggaggccgagggaggcggatcacttgaggtcaggagtttgagaccaacctggcccatatggcaaaaccctgtctctactaaaaatacaaaaattagccgggcatggtgtcacacgcctgtaatcccagctactaaggaggctaagacaggagaatcacttgaacccaggaggcggaggttgcaatgagctgacatcgcgccattgtactccagcatgggggacaatagcaagactgcgtctcaaagaaaagaaaagtcaaaaagtaggccaggcatggtggctcacgcttataatcccagcactttgggaggccaaggcgggcagatcatttgaggccaggagtttgagaccagcctgggcaacatggtgaaatcctgtccctactaaaaatacaaaaattagctgggcgtgttggcatgcgcctgtaatcccagctactcaggaggctgaggcaggagaatcgcttgaacccggaaggcagaggttgcagtgagccaagattgcgccactgcactctagcctgggggacagagtgagactctgtctcaaaaaaaaaaaaaaagaaaagaaaagaaaaaaaaaagtagccaggcctgcaatcccagctactggagagactgaagtgggaggattgcctgagcccaggagtttgagaccaacctaggcaacatagggagatcctgtctctaaaataaaggtataaaaaagtgtaaatgtaaaacctccatttgcctactgctgactgaaaggggtacccccttttttgcttaagagacaagggtcttgcttttttgcacaggctggagtgcagtggtgcaattatagctcactacagccttgaactcctgggctcaagcgattctcccaccttggtcccccaagtagctgggacttcaggcatgtgccaccatgcccagctaatattttttatttatttttgtagagacggggtgtccctatattgctctgcctggtcttaaatttccggactcaagcaatcctcctgccttggcctcccaaagtgttgggattattgttggggccaggcgcagtggctcacacttgtaatcccagcactttgagaggctgatgtgggcggaacaccccgtctctactaaaaatacaaaacttagctgggcattagctggacctgggaggcagaggtcgcagtgagccgagattgcaccactgcactccagcctgggctacagagtaagagacgccatctcaaaaaaaaaaaaaagcttgttggggccgggcgcagtggcccatgcctgtaatcccagcactttgggaggctgaggtgggcggatcgcctgaggtcaggagttcaagaccagactggccaacatggtgaaatgccatctcaactaaaaatacaaaatttgctgggtgtggtggcgtgcatgtgtaatctcagccactcgggaggctgaggcaggagaatcacttgaacccaggaggcgaaggttgcagtgagccgacatcgtgccactgcactccagcctaggcaaaaagagcgaaactctgtctcaaaaaaaaaaaaaaaatgcttgttggggcccaagttaattgatttcacaactgctgccttggcatgagattgagatgcgtctctatatctctgtctctgtctctgtgtctctgtctctgtctatctttgtatctcacacacaaatgtccaggtctgagctctgggtcagaactgtggtccattctttgcaaactgagggtccccactctcctgagccattggccacttgcccacaccactacccaagaccagtcccacctccggacacgtcgactcactgtacacggtgatgttagaggagcctgttatctgrgagccattgcagtacactgagcagaggatccgactgttgccagtcacgttgctgagattgaaggctgcccagcccatgccactggccaccagctcctttgatagggacgtctccaaggcgattttctcagagctgggacaatcagtactgcagttcacaaacagggaccctccagcagagagcacagggttctggggctccacccgcaaaaggaactcctgcccctggacaccttcaggaacatgaagaagtcctggtgtttgtttccttgtyccccaacccacgcatcaacaggccccaccatttaacacctctctccttgtgccgagacagaagggttcctgccttcatggtccagkgggaaaggtagaatccatcagagaccrgggagaactcagaaggaggccagaagaggctctgatccagcataggaggaggtgagtcagggaaggcttcctggaagcggggaccattgcagcccgaaactgaaggctaagtaggagttagcaagtgaaagggacaggtgatcctggcagagggaagcacatacgcaaagggcaaatttcaggagttcagatggagcaggaagcatgaggggtgtgtgtgtgtgtgttaggggagagggatggcgtacaagcctatgctggggcctgaccacctgaaggctgaactaaggaaccagaactttctcccgaggatacagagtcagcggccaggtcgcagtgtggcaggatgtgaacagcgttgcgttctattcctctaccctctactgatccccaaaacgcagccctctccagccctccccggcttgactggtctcacctggggtcagcagacagcagaccagcagagtccagcaggccctgggccacaacacggatggtaccatggtrgccattctgacagaggaaggtgccttcctgaggtgcccgaagggcaggcaggggaaaaggcggggcctcccactgcgacggaagcacagcggttaagattgcagaagtctggggactgcaccttgcccaggcctgtgggtggaaggggatgctgtggcccttgggggccagggtgggggacccagacggggctctgcaaagtggccagcactgctgagtctcccccagggaatgggctggtcccagttgcactgctggcccccatttgaattcacaggaaatgctaactaaactggtttcttttgttctcagcactgggaagcctgggtgggggggatgaggcatctccttctggctgaacttaggtgggtaggggaatattctgtccccagagaggaagttaatggggaaaactgtaggcaccattgtgtagatgttaaggtgggatttcgaggaaacattaaaaaacaaaaacaaaaacagaaacagaagcagagtcttgctatgttgccccgactggtcttgaactcctggccttaagatggcctcctctcatcttgacctcccaaagtgttgcgattacaggcgtgagccaccacgcctggccacctttgaagatcttgaggatacctccctatctttgaagatcttggggatcccccatcccctgcacaaagagctaaggtaggtgatttggggacagctgaktccctgagccactgtctatccaggattctacttggtttttgtttgtttgttttgagacagagtctcactctgtcacccaggytggagtgcagtggcgggatctcggctcactgcagcctctgcctcccgggttcaaacgattttcctgcctcagcctcccgagtagctgggattacaggcatgtgccaccacgcccgg

SEQ ID NO: 2 - DNA, 76500 bp, Homo sapiens
tagacagtcatatataatggaaactgcaaacctccgaaagtgtgtctgcgtgtgggcaaatagtaaaatagcattgaatacacaatgtcttcaaacacagtacacaagtttgacagttattctaactgctctaaaattctttttatcagattcactgctaacatgcatggaaaatatgatgacaaattcgragattcctaaaagagaaaagaaggctatataatacaatcaattattacattgtcttttttcacaattctgtaataattgatggtaattcaatagatatttatctttatctaactttatctttaaaactatcccaagtttacttattactgctacggttttaaattgcagcagctgaaatatagtaggacaaatgcataatttggaataagactaaatattgcatttcaccttgatcacatcgtctctgtgccctgagcaaatagtttaacttctctaaccctcaattttctcatctgaaaaaaaaaatgaatcctctctttcggactttcaagaaatttaatttggaagatataagggaaacatttgcatctactacagtgtttctcaaagtgtaatgcacccaggaatcacctggggattctgattcagaagctctgcattgggtgctaaaattttcagcttccaggtgatgccagtgctactattctattattgctgatgttatctggaagctggtttataatgcaaaatctcatgtcccacccaatgcctactgaatttcaatcttccttttaacaggatctccaggtaatttttatgaactttaaaatttgaataacattgatgtagcagtagatcttgcttattgctgatatgcagtcgaaaatattataagttttgaatcatcacaagaaaagtgtgtagaatataaatgaatataatatgttttttcctcttcaaaatctgattttgaattatatttcccaggtgtcaccggaagctaaagagtggccttgcctcaggtcaggtttctactccctgacagcctctcaattagctgctgttgtaatgaaattatgcattgtcaaaagcctttttgcatcattttcttcaccaaatctcaagttttaagtattttatatagaaactacataaaatccaaccctgctctgcccattccagtggctgccagatagctggttttctttgtgattttgggctgttggttttctaggagaggaggagaagattagagcaagttaaaacgccacagaccttgctgctcttactgagattcagccatttttcttaagtaaacactctccagattgcatcaagccattagttaatttacagaattccaaaatagttgattctggagatttttgctagttgcttatatggtgaagaggatttttggaggtcttcactacaccattctggctgatgtcgcttaaaatgccctgaagtttttgaatggtgaacaaaagtcttatggattttcattatcttgatayattagagaaaccatgcatccacctgattgtattgggctccatttacagatgccactaaaatatcttgatagtttgaggcaattattagatgagaggtcacagtgacctcctcctaagaaatatttctcagaattaaatgtcaaatttttaataaacattgtattatgattaagagcccaggtttttaatgaaccctgggatcaagccctgggtctggtccttaacgtgtaaccttaatcaagttacttaacctttataatacagtgataataacagtatgtatgtatagatttatttcaaaattcaattaaattacaaaagcaaagtgcttgacacagttcatggcacaaagtaaatgctcaagatgttttagcttctattgctattatcatagttaagaatatggtttggtactgataataataatgaatgttctcttgaatgtgtttctttaagagtcacattgaaatagaaataaataaaaactgtctcactcatgctactttatgttctatgcaattctaggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagaggtaaggaaaatctggaggtcgtaactaccagagagggctcagtagcctcctactgtgggacaggatcacactgagggtgacatatgctggctccaaagtcaaagaaacacaagtttgctccatcatttatgagctttgtgactgtgtgcaagttagcttcatctctgtgagctttgattccctaatgtaaacaatttaaatactagtagtatctacctcaaaagcacataagaagtgattgaacatttccctggtacagaataggctcaataatgtcatctttgattattattaaatagatagatttgcattagagggctggaaggagaggggctgtgaggagatggacagagcattaggagcctgttagttttcactaacaagaaaaggatgaaactagggtaaaaaaagtagaagtaaatagacctccatgttttattctttcaatcattgaatgttgagagagtgccttctatctgccaggctctgttccagacgctgaggattcagatgagctgagagaggccataagagccaggtgacataggggattgacaggctgattttcagcctttgacttttactctgagatagaaatccatggaggtttttgagaagaggggtgacgtgaagtatgttcacatgaataaggaagactgtagcctaaatgaggaaaaaagaatatgatttrtaaagaagcaattatgctaaaacctaattatatcaatgtgcatcttctcataaaatgatcaaagtaggagtagctcctctagtgttctcagtcccagtttcaggctgtgtgatttggacaacccttcctccatggtgtgctaggatcctcagtyggttgttaagttggctttaatttaccttaatatgtttcctatccattcatcaattatcagacaaaaagataacgtactttcagaagctatggcaaaataaatattaaaaaatactacttataaatgagattgaaaaattacttccttggaaagtatttttttggtaagtttcactgagtggaattgtggtttgaatttttctatataatggagagtgacaggagatttaaagaaaaatatagggtcattatcttaaaaggttactcttctttctgaatgtagtttttggaaccactatgtattggaattctgaattactgccaatccatgatgataaattagcatttcacactgggaagcttatattttgaggcaaggggtcacactttaaatgtagtagaaaaagaaaaaagttatcactatgaatttgcagatggatacattcatttctgaggatgttgctgatgcatatatgttctgagatctacggtatatttcagagattttgataaactgatagaacttcccaatagaggtcatcttaatgggccatttcagtgtcacattcttaccctcrtgacaggccaagggagagctctgcagtagggtggagggtgggggaccgctcgtggcctagccatgaaattatagaaagttaactgttctggctaaattttgatcatttctgtttagagttattcatttttctttaaattcctttataactttaccccacaagcattgaaggtagatggatggatagataggtaggtaggtaaataggtaggtaggtaggtaggtagatgatagatagatagatagatgatagatagatagatagagagatagataatagatagatgatagatatagatagatagatagatagatagatagatagatagatagataatattttactttgtttaattatcaataagatatatgtttaaatcatttataactttaccccacaagtattgagggtggatggatggataggtaggtaggtaaataggtagggaggtaggtagacagatagataatattttactttaattatcagtcagtgagatatatggtttttagttttgaaacatatattctttttccctctccaaattggtttctaactttttcttttcttatttttttttatgttttattttttgacagagtctcactctgttgcccacgctggagagtgcagtgatgcaatcttggctcactgcaacctctgcctcccaagttgaagcgattctcctgcctcagcctcctgagtagcttggattacagatgcatgccatcatgactggataatttttttttttcttgtggagacaggggttttaccatgttggccaggcagctcttgagctcttgacctcaaatgatccacccacctcggcctcccaaagtgctggggttacaggcataagccatggcactcagctagtttctaacaattttcttaggaaatattgtattgtggtcagagaagttcatctggatgatattaattatttggtctattaaaactattcccttattactggattgggattctatatatgaccaagagatcaagtctgttaatcaggctattcaaagcttctgtatttcttctcatttttatcagctatatcaataatttttgagaaagatactttaaaatttcctatcagtattctgagtttatcagtttctttttataattttgtcatattttatattgaacaatttgaggctctactactaggtgaatagaagtttggagttgttcatatctccctgaagaattgatccttttatcattaattagtgcctatttttcattgtaataatgctttttacctgaaactctattttttctgatattaatattgtcctaccatcttcctttgattagtaacttcctgatatgtcttttcctttatttaactttcaaactttgtttgatgatttgatctaacaacttacatctttacaattctggaatatttttttcatcatctttttgtctatttcatcttcccaccttctcaattttctctttccagaacccttattaagctatgtttgaccttgttaatctatcctctgtctttgttaacttcttttttccatattaaatttctataattatcatttttgaggcattctaggtaacttttctcagacctgttttgtagcttactaatactctgatgagctaattcaattctgatacttccccaggcccatgattggagattttgtagtctcttcttcataaaaacagttaatgttccaagctctcagttaaattacttgtagttttctgcctgcctaatactggaggcctcaccttctgtccccatgtgaaaaagaaaaacctagacccaagctctgtggcctctatccaagactaatatccttcgtgtgcttctacttattgttctatatttcggtttcttccttggttctgatggctgaagctgctgttttattttaaccttgatgatgtattttaaaaatatatttcttaaaacttttccagcacttttatatgtttgcattgggagggatttcttctgtattcaacttagtccttttcattcctggaagtttcccacaagcacctgatacatacaaatgtgtcaatatattgttttgtaagggttgtccttctcagtattttaatttcaatttcttccaaaattttggctctaaaatagctttggaaaacaaagagaatatattgtagaataattctgagtggaaaccagcatagtaccaacttttcatgtaaaaatgtggtcatatgtttaaaatagccttctaaatgatgtaggattacaaaatatgaagtattattttttaaaattctagttgcttacaaagagaaggaagattaatttttaagtgttcttattatctggatgaaatatcaacatgtggggatcaaatttttcaaagcagaaacataattgagattttaatttaaaaactgttattaaaataatcagatatctgagagctacacatgcattaacctttcaaatttcagtggtatggtaagtttgaatgagtcccatgggacttttgctcagaataggagaaattaaaaagtcagccgaggccaagatacatcttaaataaagatgtaactttaatacccctcttttgaataatatatgtatatgatttggatcttagtggttatggagaaaacagtctctgtttttaaaaacgttactgcgaattctacaattatccaaaagctatacaaaacaactatcaatttatagagatataaaatacctatgcccagagctatattaataacttgggaagcagtgagaattggggatggaaaggaatgggctttatttttacaaaatatgagatgcagtgcttatttaacacatgtgatctttacctctcgtatcaatgtaagctcattactttgggtactcttttataagatgggactctatatgctgccaaaaaccccattcttagcagtgaacttaaccaacaatgacattttcctatcactatttttccttttatagaaggcaaatgttattgccctcttttttttttttttttgttaactatcagactttcctgctgcatttagtgtagtgaacttyacaatttaatgtccaggaagctttctgcctcgtctgcccggcatgtgttactggcttatctgtgctggcattcacttatttactattaaatgacagctgcttccaagagaggccttgggacctaatgactaaggtgacagtaaatcatcttagcaaacagtaaaataatacaacaaaattacatcctttaaatcattgaaagggctttattccaatttcctaagcatcataaagagtttagaaaatatttgtatgtctcttgcatttcaagtgaataaaatcactttatctcttactcttgcgtccccaccccccaccccccccaacatcctttgtagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatwtgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctgsatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcrtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccatagagttgttatgtggtcttaatgagatagcttgggttaggctgagcacagctgctagtagaatccaaaaaggggccaggcatggtcgctcacgcctgtaatcccagcactttgggaggccgaggcgggcggatcacgaggtcaggagactcagaccatcctggctaacacagtgaaaccctgtctctactaaaaaaaaatatatatatatatatatacaaaaaattagccgggtgtggtggtgggcgcctgtagtcccagctactcgggaggctgaggcaggagaatggcgtgaacccgggaggcagagtttgcagtgagccaagatcaagccactgcactccagcagcctgggcgacagagcgagactccgtctaaaaaaaaaaaaaaaaaaaaaaaaagactccataaatgttaacgcatattttctttctttctttctttctttttttttgtggggggacagtctcactgtctccttctgtcacccagtctggagtgcagtggcatgatcacggttcactgcagccttgacctccctaggttcaggtgatcctcccacctcagcctcccgagtagctgggactgcaggcatacgccaccatgcccagctaatttttgtattttcttttgtagagacagggtttcgccatattgcccaggctggtctcaaacacctgggctgaagctgtctgccctcctcagcctcccaaaagttatgcaagatgcatagcaatgacgggtcacttaatttgtctgggactacaagcgtgagccaccgcgcccagccaactcatatttttcttctctacccacttcttcactcataaatttgctcaccagctaatctattccactcatctttgcctttttaatctgctctctttaatcacttttcccttaccttttgatgaaggcatcctacccagcgcgttttgttccagcatctctcctgtacttttgtcctttgcaggctgccttttcgaaattattcatctgaccatagcttgatcttgctcattacatatgatgactgtcacttgcccaggacaaagcccttcacatagtgtaaaaggtcctactgccagtttcattcttgtctcctaccacttcccaccacacctgccatgccatttcatacctctagaactttccacttgctattgttgtgtccttcttgcttgccttctttctagctggcatgctccaaacatcctttaagagccaaatcaatgtcagtttcctcatgaagcttcccagaatctcaaatcagtgttagttgctttttgtgcccccattcgcattatctctttctgtctttcccacatctgattattttctttatcaaataagaagcaatttaggagggagagtgatgaagtggaaatagcagaaaattgagagccattcaaacctagatctgcctctcaacatgccttatgcaagatacatggcaatgccaggtaacttgacttgtctgatctcatctacaaggtggagataataactcctacaaagtagggatgttgccgtggttaatggtggtatgtaatgtgcttatcccggtgcctgtcactttgctccactgataactctattgataaatggagcttcttaaggggccaagattgtatcttcttgctgttaaatccctccatgccttatgccaaagagaatgtcagcacagtgagtttgcagtaatttttgggaatgcaaatatactcaaacacacacacacacacagggtgttttgtggcctgtgatatttgagggatgatattatcaattttaattgtcaatttcagtgatgatggcactaatcaatggataccatgagcagcatgttcatctgggtttccgttagtcaaataaaaagcctagacaatattaagtacaattaacataagaataaattggaaatcaataaggatacaaagtagttaggtagtatcaagatttcatttgctacatcctgtatatgcctctttaaaactatttaggtaattaaaatgaatcttaagttataaactcgagaaaggatttgctttcagatgtggggcctactgtgttagcctcactattcaaactagatgtctgggtatcctttggagaacatttaaggtagaattgcctatgatgtcagctctactgaaacatgattttattatatgtaacattatgaaatgactaaaatctccaggtggagtttaagtaatcattcccattgattctcaagctgggatattcttcaaaaaatcattcccaggctgggtagtttatattattgatataattatgacaccttgaaaattcaggagagcattaaataatgtaatgcttgccgcaaaccccagtgttccttacactgcagagctgcactctgattagagtaccatacgcatgagttttggaatctacgaccagggttcaaacccagctctgccacctcatagctttatgaacctaaattatgtaatatatataagcctaaatttgtttttttctggaagtagagttaatagttcctcccttatcatatttttatgaggaatgtagtacaataggtgaagggattaacatagtgcctggaacatagtaagtgctcactaaatggaaactatcagccctcaaattatttctgttgaaagagtgtttcagcttctaaggaacgtagcaaggttctggactcagggatatgaccagcattaaaagtatcatgatcaccagcacaggatataattatatcttggtctcagagactcttaagtttatccgtgcccagataatctgccagggattgatggcaaggaaagtaacccaaaccactctttctttctgagataatacaattacatccatgatctgaaaatcatgtctaaacaactacgtgtaactgtccttcatcaactctatccatgtctacactaaagatgatgttgggtgttaaaggtattggataaaatacaatgaatgtttctgagggctatcatgaataaactgagggctgtggactaggtcctctggggtacataaacttacagttattgccatgttatatgatgtgctgtggaagtaactaaagagaccataaaggtgaagctcaggagagcactgcagagccgtgactttggtgtgagtcctaaagaccagtaggaagtcatcagacagagctgcagttttggtaaggggccttcctagcccatggaacagcatggcaaatgtgccttcagggtagaccctagggagtcttttcaataaaataaacatgacctaccaagttcatgccatcaagatggcattgtgcctaacaccttagcagcacgtcatgagacctgaaaacacacttagtacccacgcggcttctactctcttattcaragaaagcatccagagctggaaacattttgccttgtttgaactcacaaactacaggaaaggagtgctggaactgtggctcccaaaggtctgtttcattattctctttatagtcttcttaactgcacaagtggggaatgagttgaaagttagaactgcccagcttaagggcctcttgctctgaagtgacttggagaactaacagttccccaggcagctaaaatctactgaacctactgtagatctttcagtaaaaagtttagctgatgaaaagtgtggtttttaaagcaccatttgtggctcaggtccaggkttgaatgatactccttatttatgaacttctgtatagctgctgtctgtatggcctcttgaaggataagccacagtgaggccagccttttcttaaatagggaatgagggcaacaggasaacagtgaattgttagggggcaaaccaaattggcatcattttctttgagcaaaactgtctcttacttctgggggaggccccgagcatcccacctgttcttgcgaatagaggatgtccatcccaactctctcttctccacacacccattccctgttccctaccccctcatgattcactagattaattatgcaccacactgaagtgatccccagggtcatgccatcagaccctcatcgctggttacctgttgccaaaatagtccaagttcccatgccatttttccttcatctatttgcttatccccatattgcccagtgtattctctcatttgcttctatctccaatggcctccccctgcctaggacttttccattatcccctctagatcttacaatgccatcaccctcccctatgtcctcttctctgaatcatggttgcctcctgaagacacmatcttccctgcagccctctcaagcctagctatcttcctctctacaacctgcgtatcattggcctgaaggggagacatcttgctttgctatttgcagctactttcagacctttaatccttcttcctctctaatgaccttcttacaagcacatgtctccttatcattgactgaatattctagcacctaacccactcaccctccccactcatactccattcaccatcttggccactcagctccttgacgacttttgaaaatcttgttctgccgctgcctgaacatcagccaccacactcatggttacactgcgtactgtgtcatgactaatcactggcatcgccaacagttccatttcaagcatcccacgctgtggtcatcacttcttctctctctagtcactccccttagcaccatcactccaaattggtaagttttcagcgactatcatcccccatttcattacttccctccttgaccagcttagcttctatggttccttctcataattattctcttgcccccatttccaaatcccattatgtactctcccagcactgtactactcttttgagaattaaaaagaaacaaattgcaactctagtaattttttcttactcttaacctgtgcctaaaaaaactaaacatgactggagaacaaaagaccaccaagttgacctgtgttcctttgtatttatatkaatatggctcacatggttttcatcactgtccagtaacttattgtcacagtttccaaggtcaatttcacacttctcaaacttccacaaactcttcattgtctactgacaaccttacttctatctttactgagacaacaaaaaaaaaaatcagatgagtatgtacttatgcccatcacgtcaccgtattcccaaactacctgcctctgtgcacaccacctcactgcctgctgcagttactgtccagggccagcgcctctgcccatgtactggagcctgtccctccacccttttcaagcatgttactctatcaaataaatatccctttctcttttgcattatcagttttgctatctctctgttggccccaccagcactattacccatgctatattagcttttaaaaaawtctctcaatctcacatttatctccaacgtttacatcattcttttgctgcactttgtagaaaaatattttgaattttctgtatctatttctacttccttacttcccatgttttcttgaactcactcgagttactcttttcttgctcaatactggatagaaactgctctcattggggtcatcgatgaccttcaaacagatttagtccaactgtgaatcttcagttcccattttactcagcctctcaataacaatccgcccctgcccattctctcacttttgaaacaccttctttacttggcttccaggacagcacactcctggttttccctctacctcactgaacattctggaataccctcctgttttctgaggtctgtatgttggagtgagaggcatctccatctttggttttctcttctttaactacactgtcttttggtgggctcatacaggctcttggcttttaatactacttataaactgattactctcagatttctgtttcagctcaccctcttccttgaactccagcttataagacactcctgctactccacgtggattttttttttttttctttttttttttgagatagagtctcactctgtcacccaggctggagtgcagtggcttgatatcggctcactgcaacccccgcctctcgggttcaaacaattctcctgcctcagcctgagtagctgggactacaggcacatgccaccacacccagataattttttgtatttttagtaaagatggggtttccccatgttagccaggatagtctcgatctcctgacctcatgatctgcctgccttggcctcccaaagttctgggattacaggcgtgagccaccgtgcccggcctccacttggatatctaataaacatctccaactgatattccaaaaacaaacatgattttctccccaatgtttttctaacccattgttcatcatctcagtcaactgtaccatcatttacttcatggtttaggtaaaagaatctagagccatttctgatctcttgcttttatatcacaatatcaatctatcagcaaatcttctcagctctgccttcacaataggtccagaattcaaatccttctcaccatctccttttcctagtctaagccccatcatgtctttctggattaatgttttatcctacgatggatttttttgtccccattcttatctttcttcctaagagtcctctttactcagtagccaaaggaatccttttaaaaagaaaatttagcttatatcatttcctttttcaaatctaaccaccatcttcccatatttagaatcaaatctcaagatcttgccatgctctgacccctgcttctctctccaatttcatttacaatcccatttactcttgttcattctgctttatccacaagactctttgcccctccttgtctatataaacaagctctccctccaaagcctgcccctgctttctcttcagagtctgaaatgcccttctccgtgtcaatagctcactctcacttcagtcaggtctctgagcacttatcccctcttctgagaggcttgccctgaccaccttgtctaaaatagcatccctttcccaccttactttttaacctgctttgtggtcttcgtacttacctctatctgacttctccactagaatgcagaccatgtgaaggcagatttgctgacttcatcacatcaactatgtgtacctagaacagtccttggatggttgacgtgcttgataaataaatatttgttgcatgaatgaatgagtgaatatttagagctctatgtcaaatttctggttcagatgttcagggatgttctcagttggaccttttaataaaaaaaaacaataaatgaccaaattctactttaagttattttagggttccaacagtcacccatagactgaacaaactccgaagatttggcttcatgtaagaatgtcactgcaaagaagcttcagtacccattgtgatatcatttgctaatttggagattgtgatgccaaaagtataagccccatgctcagtcagcatctaggtccaatagctctcagaggaaccatacatcaaagcaaactttctgcaatgcggaaaagaacatccatgcatttttaaaatgaattttaaattttaaataatttttaaaagtggtttcatctcttgtaatggaaaatattcaaaattctcatgctgattcatgaagtatacttatataattagacaaaataagaacattgaaagaagcagactccttgtttcatcgctttaagcaaataataaaaatggactcrtgcaagtcacaccactaatttaaatacattttgtaaaaagatagcaaataaatgaaataaaaatatttgctttagtttttttaaacaaagatttattaactctgaattttttaggttaaggaccatgcaatatatatctcctacaccgaagtgtccaagaaatgtttttggagtaaattaatgaactgctttagaatgttgctcagaaattaagctagaaattcagagcaatattctcagggcttgatttacaccaaatccaagttcgcaatgtattaacatgaaggaataggccattgctttctgaaaaccttccttttataaaagaaatactttaatattatgaattctcttggtctgtgtaaaatattatttgcattataaaaattgattttttggtataattgttcataggcaatattttcaccaggatgggttcacaagtgttaatggaaggcgaattatgtgtgggacagtcttctagggaatatgtgaggggtttttaagatggataacattttgtacctgcttttgagttgcaaatgatctggactgttggttaaacatcgcagacaagatcaggtgaagaacattactagaagttcagtgattaagaaataaagccacgtaccccacggagtgaaatttgaattccttaaattccctcaaattattttatgttggattttacaccaggataggaatgtctttaaaagtaagaaatatttgacataaggtagaaaatttcaaaggagtgtttgacttgttgctggatgtgtcaccacatttcatgtgtctgagaaatataaatttctacagcacatttttagtgccttaaacagactacaatgatgtaaatggttgaacagttgaaatttagtctggaactgggacagatgacttgccacatagagtggctcccaacataaagtgatctgtgatggcaggactttcagcgtgtttcactattagcatgtgtcatccaagcatgcctttcaacatctgtggagaaaagacatgttacaaatacaaaacaccaccatgatgaattgggaatgtcaaaaacctctgccttggctgtgatccagtgttgttattggcaagtagattcatccttctaggttggttgctccataagtaatcttcaagaaaagcaagtccaacacccttttttctccttactgtgaacttggtcaaaattaccaaatgtttggtaaccatttatggtatcaggaatgcaccaataactccttctgactctttaagagcaatcatcttgtggaatgcaatttcccttcttattattgtgggtatttttaggtacctatgcttgaccttttttaaagagagtaaggatctgtgatttaaactaggatagaagctgttccagagataacaaaaagctgttgctttctatattccaacaggaactaggtaaaacgataaatgtgataactcaaaataatgtgtatgtttatcttccaggctttctaatagttaattggttaaataaaacattatttacagaaatagaagagccactcctcaactgttcaaacactgcaaagtaaactaatgcaagtgcagtgacctcttcatccagccacaaaatcatatatatttttaattctccaaggagtttgagatagtaaagttggatatcatgtagctaaacaaaggcttttaccttttctcttggaaaatagttaaaatgaatagraatctgataattaatctgggaaatttaaccctgctctacttacctaatgcccccccaaaagatgatcttttttttcttcattgattttataccttaaaaagaaattactgaattgcagatatacaactagtatctacagacagaaatgmaggtcagttttagaagaaaccagtgtcaaatgaaaacacagatttctacatggtcacattcatatcacacactcttgacccaaggtgagaaagtaggtcattccttatttcttatttattccctggcacaatcagaccacactacaagtttcttttaccagttgccaaaatgaaatcatgacacccttcagagctactgtcgttacatgcaactcaagacaacgagcagcatcataaccattgtcaacaggcaaactccaacaatgtctgggtttggatttggttttatgttgagagaagcagatttcctctgattttaataatccataagaaacagaaatcataatatattgactccatattacctaaaaagagtcaaaagaagcagaagttctcccccgattcatcctcttgttccacagacattttgaaaataaaagaagacaaaatagaaaggaaagggtgtgagaaagaacacagaaatgacttgaacgatttcaaatccttattaagcatcactgaggttgcattttacccattagactgactgaatttagttctcactgctcagaccttgcaaagaaactggacgtacatggttttgccttccagggttgatctagaactgtaagggtgcatgtgaatgtgggtatgcatgtgtgtgtgctttaagtccattttataaacactgacacaagacaattctcatcattggtaatagtctttggagtccaatcatgcagaaaaacaggcaggtgcaagttaggtctcattgcaagatggacatggcaaggtgaacagataatcctacataaggattgggagatttgtgtccattagaatatactggccattggtcccacataagtaaagttacatatacaagattctatatataaacagaggcccctcacttcagtttggctgaccaaagaaacaggtcaaagtgagccattttcagatagttaaaggactaagtaccaaaagaaataacaaaatcttatcctctaatcacaaagaaaatagctaaaataactatttacattgcaacttttttgttgtttttacagagaggagtttccttgcttggcttaatgatatctgtggaaaatgttgaactcttataattaaaatgtgtgtgggggattgtgagtggggagttgggttcctctttggatgcaaagtggctgagatcaaaaatttctagagcaattttactcctctttctgagctgtagaagaatacatttttcagcaaagctggctaataacatgccttacagagcataatgcacttaagatgtggcttttcatatgttaagagattcaaatcgaaatagattttgtataatttaggttttgcaatgaatatttacaattttaaaacaaatcaagtttgcttatttttttttccttgacaggacataaaaggttttacatatttttatctattttttactagttccatttactaaggccaactttcagttttaccagtcagctgctatcagtgtctttagataatatttttctgataacagattgaaaaaactatcgagcttcttaaccctcaattaaatagcttactccaattggtgggaactggccaggctctggtccaactgttgggtacattcctacaaaactcagtcatcagattcttgaagatgaaaggttattatcagtttttattccacaagaagaaattccgttgtaaggctagtgtattcctatttaaaattgaacacgctgacccacaaaacacatataaaaatagtaaagacatattaatagtaaagtggtggcggttttgccaaactcttgcagcagtttaattttccctgcacatgagtacacagccatccttcctacaaaatactgcaaactattttattaaggatcactgcaaaccaactgccccaaaggaagcctaacagaaggttaggctcctcagagtgccaacttcatgttccaaaatgagccccaaccccaggtagaaccttcactttttttcaggaatattgtccaggtgacttgacacttgcctaccggaaaagttgggatgttcttgggaaataacaggtgactatttaagaaatatttggggtgtgtgtgtgtgtgtgtgtgtgtgtgtgtgtgtgtgtgtgttaagacagacaagtgaatgcagaacatattatattctgtgaatttgataatatcatcacctcctagacatattataggaaagcagacctagtgggcaaaggactggggggcttttacagtggtgattctctttgttgttccatcatctgccttgctttaatcacctaataaaactgatcctgcaaaaattctgggggccaaatccttacctctatttgtaaatgatacttatattcaaggaatttgttccatttttctcttgtccataagggaaatctggctaaagctaaccagctcccaagagccatgcacagaagatgtaagactaattgagctttgggaaggtactaacagcgggggaggggccctgtctagttcttgcctggtttacyctgagggggaaattcaccacttatgcaggtacgagagatagcctgtcaagcactttgaagatgctggctggagacttccttctgtcttgtgatgtcatcttgcggctgatgaaattccccttgagactctctttaaagcagcttcctgctctccgcacttaatcccatgtggtataaagtaagggaggggagaagccacagatatatcaagagaaaagtaccgagaaagaaaatcagtaaagaattagagatacagagaggagaagtttttaaaaaaaaaaaaaaaaaacaggaatatgaaagagagggagctcaagtgactgaggaggcatttttaacaatcaggttatctgcaatattaaccagaaaaaaaatggtagcaaaatagagaaaatgggccatttttattccaggggacaagctgcacaaaggaatgttcttctatttattttaaacaaatgactgcgtgtactgaatctgactgtgtgaaataatctcagaatggcagcaccactggyatggcgatggtgcaggtgggtgcagttccctgtggtctctattgcttgaagagagaaagraagttccctattattatatttaaggcagttttcagagcactggcattcttgtttgctctgttttggggatattctatttgccaatcagttcacactcatcaaccatccacttcctgtctttcacttcttcaggtgaaatatcaccactctagtgagcaccaacatggtcagagtgcaaataactgtgatggatacttcgaagtgaataagaagggaagcctgattattgctgagatcaccttggtattgccttgtacataaccaagatgtttcacagtgcctccttaagtgctcaggaaagcactttcatttaatttaatttaagctaaattctggagattttgctaaacattgacattaatgcttcatggcttttaagacaaactcatattgctaaaactatttggcagcagtaaatttatgggcagagttattgctcttacatctactgcagtacaaaactcagatgatcagcccttcgattgctcatacttattaaaataaataaataaacatgaaacatcagccacattaaggagtcagggaaactcctgaggaataacaatgtctctggagatgttttcaaatgctaacctgagactcacactgtggtttgggggtttcattmttattattattattttatttcagaagaggaaagtaatattatttctcaaaataaaactttggcagagtatgaatcagggaagcagcccacacatggaaaacacaatccacaatctgaaagtagtctaggcaggctcatttttttgttgaaggaattcacatggaggcaattctgctcagttccagagagagattcttatcatcaaaagcacacacaataaccttgcttcaccacctgccactttctccagtggcctcttgttgtgaccagtaattgagaaatgacaaatgggtatagagccaaatctctaaaacagggacaccagtgtctcctagtatctgggtaataacctcctttcagtcttagtccacaccacacactaccctccagtctctcctactctttactgtcacagaaaagactctcagcttttattcacacctgccttcwgaaggccaaaccattttgtgcctgaaaactgttacccactcsccccacactttacataagtatcacatatgttctttctacaaattggtatacaggtgccatttaatccattcaaatttggaagctacatcttcaagggtctgagagagctcactccccccatatattccccctttacatgttttcttataagacatacagtttaatcaattaacaaactaaacagcttatatactggcaatatattacagatgggtttatgtcagagtaatagatcacatgaaatggaccatgtggtaccccagtgcattatgtcttggtagagccytgaggacactgacagtagcatctctaagtaagtagtgctgtatgaatacagacacatgcggatctgtatctacatccatctgactaggccaaggagcaggtagatgcaagatagagacacacacatgctggatggggccactgcacaccttgtcatgccatttaaaagggcagttacaggttgccggttttgcagccattaaaattacactttatggaaaaggcttctctaattgtgtctgatttgctttctgtagtaagcatcattggaagaagaccaaagcaagagcaactagaagttaaatatacatttgagcttagctgcaatacagaaccctggggaagaagcaggctgaaagatttatttaattttaggcttggattctctcccttgctgttttcttgatgttgtgtgtctgcatttgtgtgtgtgtgtgtgtctgcgtgtgtgtgtgttccatcacatcatctcctgaagaacgctgggtttcgcaggcaggcggctagtcacctgcaacaacccaggggtcctgccgaggcttccaggctgctgtcagtgtcagatgccagggtctggtcggtggacatggaggagatgtcattgacagacgaggatggagggagactctcactgctgttcactgctgcacctgtgctaagaaaatgaagaccaacatgactcaatctagaaccagacccatcttaatgccattcaggattcagggatgggcaaatacaataggggatgtccagtccatcaatcatttggcaagcctttatagagcagctgacataggggagcatatcaaatggtgacaatcaagacatagcaataaaaagtccttcatcacaagttatcaaatctcactctatatttgaaatcacctgcaacactttctattaaaaaacactaatatctggtcacattgcctcccctgcccccactgcactgcatatattttaatataattggccttgggtgaggccaaggtatttgcatttttatttatttattttttttgagatggagtctcgctctgtcgccaggctggagtgcagcggcacaatctcggctcactgcaacctctgcctcccaggttcaagctattctcctgcctcagcctcccgagtagctgggagtacaggtgcgcaccaccacacccagctaatttttgtacttttagtagagatgaggtttcaacatgttggccagaatggtctcgatctcttgacctcatgatccgcccacctctgcctcccaaagtgctgggattacaggcgtgagccaccacgccccgcgggcatttgcattttttaaaagctcctcagagactgtattcagccaagcattgaaagcctctggcttatgcaggagacaaataagcaaaaccccttaatggagccatctgagcctggttgtttttaatgcagggagcttttaaaacaaacatatgcaagggtcctatcccagaaatagaagctgaagtgaagttcagaaatctgaattacttggggaccacatctctagagaaaggaagatatataaatactattatgtcatcattaatgacaccaaacttaaaatgcatatagaaaagccagtaggacataagtaggactgttgatgaaagttacaaaaaaaaaaaaaataggagaagccttagcacagcttttgcttatgagctaactctccagcaggcttgcttacctgggatctccaaataagaactccaaattattaacttagattaacttgaaaaaattgtttatctgttatgcgggagtataaggttgaaaccctgagaagaaacctgcccayggtaatcactcagtaaaggctagctgagttgccagtagctttgagatcaacaaaagaaagatgaaccaaaggcattgtgcgatayaattaaaccagagcaccctggaaacaatccatttactttttttctttgtatattctttatacctaagcaatctgagtggtaacacacttgctttgtgaaatagctcgctattaaaaatctgtagtatagtcccctaatcaaataagagatgaggaattctcactaaaattatatcttatttgagcaaatatagtgtgcaagatctatttggtgaaaaataataactccaaagtcagttataatagtgttatcacatagacctaataaatcagaaagacaaaataaaactaaattaaggaagggragtggttaacataatccttgctcctggagtagacatttcttgcctgtgagaaaagtgtgatgaaaatgtatcagttatctagagaggacacaaacacctaaactaagacagatcacctgtatcttccatgtatttttaagttgtatttgttgactataaatatatggacgtactctatgggaaatgtgaaaaaatataggaaataaagataatgatatgcaccgatcttcaaataaayggtaagaactgttaaacttttcatatatttcttcccggtcattctttttgcctggaagtttccctggtcgtgatcttttaatatgtatttttttgggatcttgatatttttakatacagaaaagcttatgaatttttcatgttctttaaactcctaaaaatacccatcctttctaatcttaaatgtctctagaaaaggtttttaaagtcctcytgttattgtctttctgtaaataattactctatcaggacaatgtataaagttataatattccataatattccaactttgaatggctttaatttattccaactttacttaattatatcccccatagctatggtacagagctggttcatttcccctcatgataagattttatctcctagcagacagcccttggttcctttacattgcccaaatgccctgctctgtttttcacccccgattctggattaaattataccaayatccttcatattctttcataagttgctaataatttagtgtcactatgatggactcctcagaattctcttccatttatccacactcttattaaaagacagagattaaaactggacacaggactctattataaaggcctgatcaattgtgagcctagcagagggaaattgcttttttcttactatttgtctgctggatgacatatccctagactatggatgcctttcaaattatggtgctacagcttaatttagttttgacttgaggtatagaatgatgctcatatattttttgtaacagctttattaagatataatccacatatataattaagaaatttaattttcatgattcagtgttttttagtatattcacaacattgtgcagccatcaccacaatccattttgcagcatttcatcatccctaaagaaaaccctgcactccattcctcacctaccctgtagctctaggcaatgactcatctactttttgcctctataaaattgcctgttctgaacatttcatgtaaatggaagcatatcatatgtgatcatttatgactggccactttcatatagcagaatgtttttaaggcttatccatgctgtggcatgtatctgtatttcatatctttgtatggctgcataatattccattgtatggatacatcacattttgtttatttattagttgataggcatttgatggatatttaggttgtttcaactttttggctattacaaataatgctgttatgaacattcatgcacgagttttgtatggacatgtgttcatttctcttgggtatacacctagaagtggaattgctggggcatagagtaattctagctttaacacttgaggaactgacaaactgtgtccggaattggtgggttcttggtctcactgacttcaagattgaagccgcggaccctcgcggtgagtgttacagctcttaaggtggcgcgtctggagtctgtcccttctgatgttcagatgtgttcggagtttcttccttctggtgggttcgtggtctcgctggctcaggagtgaagctgcagaccttcacggtgagtgttacagctcttaaggcagcgagtctggagcttttcgttcctcccagtgggctcgtggtctcactggggtcaggagtgaagctgcagaccttcgtggtgagtgttacagctcataaaagcagcatggacccagagtgagcagtagcaacatctactgcaaagagcaaagaacaaagcttccacactgtggaaggggacccaagtgggttgccaatgctggctcgggcagcctgcttttattctcttatctggccccacccacatcctgctgattggtagagccgagtggcctgttttgacagggtgctgactggtgcatttacaatccctgagctagatacaaaggttctccacgtccccatcagattagatacagagtatcaacacaaaggttctccaaggccccaccagagcagctagatacagagtgtggattggtgcactcacaaaccttgagctaaacacagggtgctgattggtgtgtttacaaaccttgagctagatacacagtgccgattggtatatttacaatccctgagctagacataaaggttttccaaggccccaccagagcagctagatacagagtgtcgattggtgcactcacaaaccctgagctagacacagagtgctgattggtatgtttacaatccctgagctagacataaaggttctccaaggccccaccagagcagctaaatacagagtgtcgattggtgcactcacaaaccttgagctaaacacagggtgctgactggtgtatttacaatccctgagctagacataaagactctccacgtcctcaccagactcaggagcccagctggcttcacctagtggatcccgtaccagggctgcaggtggagctgcctgccagtcctgcgctgtgcgctcgcattcctcagcccttgggtggtcgctgggactgggcgccatggagcagggggtggtgctcgtcggggaggctcgggctgcacaggagcccatggagtgggtgggaggctcaggcatggcgggctgcaggtcctgagccttgccccgcaggaaggcagctaaggcccggcgagaaatcgagcacagcgccggtgggccggcactgctgggggacccagtacaccttccgcagccactggcccgggtgctaagtccctcactgcccggggccagcagggctggctggctgtcccgagtgcgggggcccgccaagcccacgcctacctgcaactccagctggcccgcaagcgccgcacgcggcccgggttcccgctcgtgcctctccctccacacctccctgcaagctgagggagtgggctccagccttggccagcccagaaaggggctcccacagtgcagtggggggctgaaaggctcctcaaatgccgccaaagtaggagcccaggcaggggaggtgccgagagcaagcgagggctctgaggactgccagcacgctctcacctctcaaaactgttttctaaagtgggtgcaccattttacattactaccagcagtatatgaggattccaatttctctacatcctcaccaacacttattatctgtctttttatctagccatcctagtgtgcatgaaatggtatctcattgtggtttgatttgcatttgcctgatagctaataatgttgagtatattttttcatgtgcttgtcagccattagtatatcttctttggagaaagtttactcagctcctttggccattttttaattgctttattttctttttattattgagttgtaagctctttagctctttcttcctttctttcttgctttctttcttctttatttctttttttaaggacagggtctcagtcgcccagcctgtagcacagtggcatagtcatgtttcactgtatcctctaactccagggctcaggcaattctcctgccccagcctcccaagtagctaggactacaggcacataccaccacacctggctaattaaaaaaaagattttttgtagagacaggagcttgccatgttgcccaagctggtctcaaactcctggcctcaagtgatcttccgatttctgcctcccaaaatgctgggtctacaggcatgagccactgtgacaggcctgtaagagctctttatataatctgggtacaagttacttaatgagatatgtattttcaaatgtttttcctctatgctatggtttatcttttcattttcttgaaggtgtcttttgaagcacacatatttttaatttttatgaaatagcatttatctgttgtttcttttatcacttgtgttttagtgtcatatctaataaaccattttctaatccaagattataaaaacttactcctatgtttttgcctaagagttttataatgttagaccttatacttaagtctatgattcatttttagttcatttttgtatatgatatgaggcaggggcccaccttcattcttttgcatgtatatatccaatcatcccagcaccatatattgaaaaggctattctttgtccatgtcttacatccttatcagaaatcaattgatcataaatgtaggtatttattcctggactctcaatttgattccgttgatctatttgtgtatcttcatgcaaatagcactctgtcttgaatattgtagctttgtagtaagttttgaaatcagaacatgtaaatttcccagctgtgttgtttttcaaggttattttggatattctgtatcctttgcatttccacacaaattttaagatggggcttgtcaatttctgcaaaaaagacagctatgattttgataagtattggcttaatctgtacatcaattcggggagtatctgtcatttcttgacaatattaaatattctaatccatgagcaatgaaatgtttttccagttattagatcctctttaatttctttcaacaatgtttcgtagttttcagagtacaaaacttgtacttcttttgctaactttattcctaaatatgtatttcttgatgctattctaaatggaattgttttatgttcattgctaatgtgtagaaatacaattatactgaggacttatttgaataagaagtttcagtgtcagtggattggatgttaaaaacagatcaaatgaatatatatatatatatatatatatatatatatatatataaaatgaatgttgtaattaactagaaagccagtggaaccaggcgattatgatagcatgctttatttatgagaaaataaccagttttaaaaataactggttttatgagaaaataaccagttttaaaactttaaaaagttttaaaataaaattgtggcataatacaaaccaaaaagtatttttaagtctttaataataatcttggtcttctcttgagataggctttttcccctatcctggctggagttgattatgtagacacattcttattgtcacaattaaagttgagtaatgattcaaataagggtgagataagtcttagctgaaataaggctcccttatagtaaaacaatttgatgtttacaaataaacacaaacccacaacaatggcagctagagaaattaaacaaagagcattgaagaaatttctccaaaacacaaatttatatctacaaataatattgaatgtatgtaacaaaagccaaagtagcttttaataagctcttcataaacaggatcgtgctgcaggctatgcttataaaacacacagcactcctactgcacttattttcaaaatcagcatattttcagcacacttctggaatattccgagtgttatgccataccagtcagccccttattatatgtagttttgttatggattacctcaagcatatatttcccctgcttctttttactgctttcattatacttcatttctcctgtcttccacaatgtctactgctgagtagtagcacagagtaagtattcgagttaacaaaacagtattgagtatcttatgtgtactcttctagataggttctgtgaggaaaagcaagttccttcctgctttccaactagtgaaactgttaagctatttttggccaaaggaaatcactttgttgcagttgtctttcttctccttttgttcatcagcagcttctctctaattcctatcctctgtgttggaatggtcctgccctctagtttatcaatgttgaatgcaaatataattagtgttcaactactcaaagttcaaaatctatcaaagtctttatcagctgtatttctagggatccatagactattgcttctgattttatatggcacaaattcattaagagaagtcttcagtgcttyctttgtaaaagttcccatgacatctgcttgtttcatgggaatggttccttgctatccagtgtgatggtgggagagaaccgtgcactgtctatggtgtcctggagctggcttttagtggcttcttagaacgaattattagcatctctttccaactctgcatccattgatgttacattgttgcttaaaattggtcacagtgagaatatttataccacaggaattgttaagtgctactagtcaattctttttttaaatatagttgttaaatgttaaccagtccaccactattagatgaaaactatttgcttctgtatgactccctctattgcgctataataaatgcctccttgcctgcagccacttctgctggatgatccattcaagtctattttcatgtaggcaataaacaggagttctaaaccataaacccaaacacaaacgtaagggacaagacatgggccttggctttaagttgttaaattactgccaagcagtttgcgaaaatctcttaaacagaattgaactgaattgaatatgatcattgtgttcagttgtccagtcaatgtgagaaatatctcttctttctatattatttaagagaaaacagtagagatacacattttcaaaaatgttttgccatcaataaagcattacaaatttttgtctataaaaatggcattaaaaggaactgaaaatgtcaatagggttgcaaatgaggaatattagctaccttcaactttacctaaaaaatcagatttcatagaaagaagtaacatatgctaaagaaaatttctcagctacaagttattcaaccaaaaaacattgttatgggggaaaatgttgttctgctttttttaaaggcaatgattttcctgataacccccaatcccaacaacaacaaaaaaatatggtagacacagaattagaaaaagcacaagaatgaaaaaatagtgtcttttttatctacatgatcttgagccacaatttgtctgggcctgagattttttaataaaaagtaaataaaattaatggactatattagtgaccctaagacatattcccatggtggggaatgtggtcctcactggggagagaatggttgcatattaaaatcacccagaagctttatctttgayttagagattttgaaaaatctctgcccatcctgttgttcagcatccttatcttagtgagtcactgttagttttgggagctttacttctcaggtggaagagggctggtgaacaaactcagaattggtgaatcagatgctctcctgtattttttctagttctaacgtactataacaaatgcttttagaagaaaattaatttcaattcatggactgctagtccctcagcaattgttacagatcaattcaggaagcaagcagctatgccatccttgaaaataaattactatgcaagtgaaatcagatagcagaagggaatacaattatttatttggaaatgtatctgaagtttagatttatctcttattgacatacaacaatttcatcaataaatttcaaacctataaattattctgcaaatgcacatttaacttcctatttacattttaaaagcatcgcataacatgggtttcgtattagaagtacttggcccctgagatactgcattaacttactcccttgctgcagaattcccagtattgccataactgaatactaacagagtgtgtgttataaaaataccacagctattttcaaaataaaatatgctacgtgaacattaatgaaaaaaagctgaatataatgaacaatgcaaaaaagctgacttttcaaacttttttttagaattgctttttctttccagcatagtttattatacacacaaaaacgcatacacacagtggtgcgccaataaaaatttaacaattggctctgcagggggcaacaaaaacgccctgatttgtagggtctgccaatttccatgttgtaaatccttcgtgcctgatttcacgttgccaacacaccaacaataaatgcatagttgggaagagaggtacagagttggccgtcatgagctggtagagtcagcgccagcacatggctgccctagagcctctccatcatgcacataaatatgtcatacagaaatgcatcccataatgtgtagcatacatatgatttctcacgaaagagaaagtcatactacatgacttataactaagtcatgaatatttttcctagatttaatccacaatcattttaactataaattggttaagccagtcaactatagtttagggcatatgtattacatagataatttttaattgttaaggtagttggaatggttaaaaagtggcttagccttctcactcaggtagagcctaagttgcatattttagaattaatcattaacacactaagcaggcctgcaaaacatccatgaatatatatttcccaaaatgaataaatcaaacacctgaaagctgcaaacctttatgtgaagcatgaaaaaatgccaatagcaagaatttatatactttatgcttggcctgtttatcttcatggagattaatagagtgaataaatatttataataatggtgtaagaacatgctgaatagtatactgtattaaagttacatgatcttgtcttgaattttgtgtttggaatagtactaagaaatatgctgagggagaaattgagtggcaattttcaaattaatatatatttaytgagctactactatgtgcaaggcacagcacccaggcactacatgggacacaaagataaatgcatacagtcttctcaatgaaattacaatcaatamgggataataagacaagaggtcaaatatttaacatacagggactagtaggacctatagaaaggaaagatcctattatttgggaagatataaaaagtcttttgggataaggtggtatgaaaaggaaatgaagtaatgataacttgaactgaagatgaatagaataggttctactaaaatttgtccaggcccagcctaacatgctaggttacccgtggctacattctgttatttctgctgcttaatgagtacatgacaatatgttctggtcattataggaattcttaaaacaaggagtcattctgccttagcaggtggcatcttgaggcttttggattctgtcttcaagttttttaatgagcaacaggccaaacgtggattagtttgaagcagcttctgtggactgtgtcaatctgtatgcgagggtgaatgagtagagagggtggtatggaaaacaactcctgtgattcccttaaccttctttgaggaagggaaaaacttgggataaaactgagtattttttcaagtctactggtgagaaaagcatgtcataaccgaattgcatctgtttgggtatcatagtggtttggggtgtaaattagttattcgaagagtagtatcgatatgaataattgattaattatttcattctacatcttttttcctaaaataatttaggaaaacaacaccctaatcagtttttctcaaaactaggcatttgtagcccccatttttgctagcaggagttgaatgtagtttttaaagctgaaaataaaccawcacattttctaaaactctttatagtgagagcataggtcttaggaaaaaatatattagcattaataagtaaattgtctcaagtcatactaaagcacattactaggatcagtaaaaaatatatatgcacaattgtgtattagattctgtggctagcaaacgaaaaattttccaagctgaccttaaccggagcccatcttggtagatgtttcaactattgtcacatcaaccttgagaagagttcaaacactaagaatgaatgagggaagaggtagcggctgaaaggattactgagctccacattgacttgatggtcaaaagggcattatggctctgaattttgatgaggcacatttaccctttagcccatgttaacattttcttcaggattcattactattaaaattatttatgaaaaagtttttgtrctggatcattaccatcagaataatcagaatgaatgccacactgaatatcaaaagaaataaaactaaaatcattataaggacacaaccatgtgatatttgtccatctgctctttaagcaatgttatgttatttcttgcaacccctacacaaaggccaagaaattacacaagtactagtttattggttattcacggagagtgagtacctgaaggagaaggctgtccttttactacaccatttttagtcttttcttctgaattcattacttccttgtagataagttctgtaagaaacagctgtgttattatagaaaacaaatttatccttcatccacagggaaattcattacttaatgccaaataattacgttttgatggggttgagtaaattaaaaatcaattgagattcctttactgctctatttctatttctatattgccttgtaattagcagagagcctggcacaaataggtatctagtaaagcagttgaagaaatcaatgcatgaaaatttatttctacgtacatgaaacatactatttatttccatatacatagtatttatttctacatacatttctacataaataacatttatttctacatgcatgaaatatttctacataaatgaaacaagtaatacatgttttacttgttttctgaattctttgggggaagtactaatacattctagctcaatctagcaacaatttttatggctttgaacatccatttttctttatacttatttcctatgaaatgcacacattctcatgactttaaattattaccaatccttacaacttccatctcttactgcatctttttttttttccagactcatatcttggacttgtaaatctaaacttgccaaaaaccaaacacattaaaaaatttagttcatttactctcagactggcatccatttttggctttctgaatgctagagttaaattggatagtttcagttctgtttactytgtccctttagctaaaaatcattccgccctactcattcttgctttgcaatggcttataatctgtataatcatcatcctttacatgtacttctttctccaatttctcacaatttagtccatgtcctcctcaaatgatggttatatcctatcacccacctattcatgagcccctaaggagtgccttcctgtccttacttggatcaaagcaactctttttcatctatatcaagcatcttttttcacttgatccactttttgtatatgttcatttttccatattcaccaacatgaccctggaatctctggaccagtggaatctctttagtatcttttaaaatttttttattttattttttattttacatatatatatagagagaggcagagactttctctgtcacccaggcttgagtacaatggcacaatcatggctcaccgcagcctcaacttcctggactcaagtgatcctcccacctcagcctcccaagtagctgggactacaggtgtgtaccactatgcccggctaatttttgtatgtttctagcagagacagggtctccctatgttgcccaggttggttctgaactcccgggctcaagtgatcccccagcctcagcctcccaaactgctgggattacaggtgtgagtcatcgctcctggccctgtttagtatctttataacattttctgcttattcctgtcctttgttttcctcttagtcctttatctgatattttcttaatattttttcttttcctaatttacacttattaattcctgcaaggtagctcaaatgttccttcccttcagctcttcccattttgatctgatcatttgctacaatctgcatttgactttctcatatttattctattctgtagtgatttagattagtagattagattaataggctactcagatacacatattttctatgtaaattctcaagtcttatcaatccaatgagtaaactcatatattgactatcttttattttctaaagtctaaaaccatctcagaattaattttaatttcatgcttcatatgatgattttatgtacaaacatagaaagttgtattctggaattctgaactaaagcttgccccccaccatgacaaacactgacaatcagtaccattttaaaaggtatcgacaaacactgacaatcagtaccattttaaaaggtatcaatggtaaatgcctttcattcttgagcaaatgtgacattgctttcggcatgaaaagacagatgaagttttaggagctttaaaaatggtctaagagaatagcagtcagcaaatcattttttagtaaattgttttacaaggaaaagccttgttgatactttctgagttcaataaaataaaaagtatacttttttaagtagtagacttacctttccattcttcaattgtgtgttctctttcatccaactgcttgtcatatatctgaggtggaggctgccgaataaaaacaaaaaataatctttgtgtgataatgtaaacataactaaactcttacaatgcacgagaataccttgccctcatttatttcggtgatttcaaccgtatataagttatgaggaaattacagtagttcagaagttaaaattttcctgtaaacttatggaggattcattcatattgcaatatttgctgctgacccaatattgctgcaatatttgcagcagaacgcaaatcccgagagctcactttccgacatcttctgatttagaacccacgcctaagcaattaatgactggtcttttaaaaaacagacaaaacacttgattacaatgrcccagaagctacttttccttcaytcacttgccttataacagaaccatgctaaaattcttctaggctaataagattttgttctatttttagaccttccctaaagaaaagtttatatttctcaacagaccatagtactagtcctcaatataaaaaaaattgagatcaaatcaacctttttatttttcatgaaataccatagaatgtctttatatattgctgtgtgccctatacttaaacgattttaagctttttggtttgtttgtttatttgttttaacctgcagaagctgccatgactgtagaggtaggtcaccttgaatccctgaatggcccttggttagtcctctctagcagaaatgatgcaatagggccttcagtctgacttatagagccagcatttctcttcccatgtggagttcaaatgtggaaaaggagggattttcacaaacctgcgtgcctactggaaagtggaatctcaaataaattctctgacctcttcttcctgatatttaggctttgggagatctaccatggcggctagggtagctccaattcaggccaagtgatatggaaagaaaaaaaaaaggctcttggaaaaataaatcaccatgaggtagagaaagaggaggctgaggggctacactggctggcaccggtttaagcgcaaagaagagctatcaagtttttgctaccccgtccaatactccaaaagcaatagtttttgtgaaaaactaaaagagtcactcaataagagtgatgcaacccctttaggacacagacctttcaaaaatggctattatagtaaggaaagctctggacaagattttcagagacagcttctggcttctgtgagagctttttggctcatgaacagcaccctcgggctaaagtgacccttctctaattcatgcagaatctgtggtagcttgaatcatgacagacacaaatattcatcctagccctggcatgctggggcctcacatcctgcaaagtatctggctatgaaaatagaagactttgcctggctgtggtgaagtaacttagcataatactgaagtattgagaaataactactcacggagccagacattcttttagcacgtttgactgatactggggcagaaggctgtaaacctcacctactgcaattcagatgtggctggctgagcagctctcagcagccgtcagcactgacaactaagcaaaatgagactctcacaccaccccagacaatagtaagaacacaacacattgaacgtatataaggtgacaggactgggatagtcaggcactgctctcaggacctgactgaggtagaaccttccacctctataaaggactctcaaataatagaaacattctgacttagtgagtgaatgagtaaaatgaagttatttttgaaaaattgtgaaaccattacctaaggaagctaccacaaagccaaactctggttttgtaaagacgctttgccaagtggtaaatttccggctttgcctcttcctgagcatgtataatgctgtggttaggccgctatccaagcgaccttgtccaggacccctgcaggacacagtgtacataagctctcagagcccccagagccctctgagctgttggcacctccttcttcttctaacaatagatccagctcatgatcctgcctggctggcttctccatgcagtggatttttccattcaagttttaaaattgaacatggctcaagagtacagttcctgccaaagttcataaatgccattttctttttgcaacaaagctattttcaggaggtttccctaggagcctcagtgtacagctgttgctgatatataaagcacaaagtacatagacactaatcacaaacaaactacaagagagaatgcaaagtgctgagttcaagatttttcctttcaacaaaccaagagggctgctttaaaccacttgatttayagtatttgttcgacggcctctgcaaatttactacatattcagatttttgattgtttgttttttgaagaggaaatgcgaatgtcacctccagtgaaagggcacattcacatacagatgtcttctatgtgacaatataaaagaataattgaccaataatccagagagagcaatgttacaacacacacgtataagtgctgggcagcaatcatcaggatgagatagttcaaaacattccctgcctccttccgctaaggagaagttggtatttgagcactcgcttgtgctctttccctatcttatttaataggaattattcttttgctaagtgacaatctaaataaaaaataaatgaggagtggggataaagaaaaatgccccagaggtgtctgttgagagagtattttaggagagtttagcagataagagtaattgagatgtgagaaatgaaggataagaggacattaaagatagtatatgaacagttatcagggcctgtgactttcaccctttgaatattttttcaaaagactgtaaacttctttcatattattttggaagatttgaacttccttggttgaaattattgcagaaattcaaacacaaatttatatggattgcataaacaataacttaaaatggattagacacatttttattgatggttaatttcatatgaatttatattggtggtcaattatatgaattttatactgatgaaacatgtccaaattgtttcaattaaatgaggaaaaaaacacaaacaagtacatggtcactgtgaattaataaatactagaatttatttatttctttattaaatgtattcattcagtaaaggtcttgggcacctaacacatggcagactatataaaaaactgagatttcaaaattgaataaggtgactgctgaccacaaggagttcacaatttactggggtaagactgatgcaaaacagatcattagtatacaacatgataaatgatagaaacctgtatatggtctaagggaacagggtggagaagtcctaacaaagcctagatttgatttcctggagtaaagtgatgcttattcagtgagcgaaagatgtgtgggaggttgtcaagataaaagaaggaggaaaaaagtgactccatgccaagagcacattataagccaagttacagtatgtagaaaacagaataggggtggtggtggtggtggtggtagtggtagtggtggtgcatgtgtttctctgtgtgtacatgcatgccaagaaaacaagaaggaattttgtcacagtaaaataaaacatgtcgtcagaagtgacaagatataagagctgtacttagagaagcagaagggtcagacaaagggtggatcaaggatgatccagggggccaggcgctgtggctcatgcctgtaatcccagaactctgggaggccgaggtgggtggattatttgaagtcaggagttcaagaccagcctggccaacatggtgaaaccccacctctactaaaaatacaaaaattagccgggcatggtggcaggcacctgtaatcccagctactcgggaggctgaggcaggagaatcgcttgaacccgggaggtggaggttgcagtgagcccagattgtgccactgcactccagcctgggtgatagagtgagactctgtctcaaaaaaaaaaaaaaaaaaaaaaaaatgatccagggtatcatgatacggaagaaagaagaagagaaaccactgaggaatgtaagagaacggaacagtgaaatttacagctggattgaagaaagatgtaactgtaagcagagagaagaggtagggagccattgcacgatctataaaaaaatattgaaagttctgactgcggttaaaaaaaaaaaaagatgagggtgaacgaaagacacagattcaggaataattaataaatgttaataaataaacttggtagaagttggtttttgattgaacatatgtgatgggagagaagaatatgagtccccaatttctaagctgagtacctgggaagatgatcgtgttggtgaagccatctaaagaaatagagaatggaaaaggggaaatgagattggtagaggtgagcctaagtgttatgtgagaagagatgatgatttgaaagttaagtatataatctgaagttcagaggaatgctgttggctagagatgtgtatagatttgagactaacagcaagtgatgtttgttgaaactatgacagtggatgaggtcacccagggaagatatgtgggtatagagagtaaatggccaaattaaaatttaaagattggacagaggaaggtaagttcactaaggcaaaagagaatagctaaagaaatacatgaaaaatgagaatattgcaatgttatagaagtcaagcaagtagaatttcacaaaaagctagtaattggccatttcttgcaaatgaagcacatgaggattttgactcgcagggcaccagaaaggcatgatagaaagcatgcctctgaaccctttgaaagctttccaaactttaaattgctatcacccccagaaagatccagatagatcttcggtggaggacgttaatatgagacatcacctaaacaattgaataaaatgtagaaaaagatcctcaacaccaatataattaaaaggaaagaaaccatagaacaattgtgacactagaaaaactataatgatctcagatctactctctcaagtctctgagaacttgataaaaaaaaaaacactgttctctatctagttaaaggaagtcactttttttctgagaaaccaccatatgttaagctgtctttatatagaccttaataatcctcacagtcaggaaactaagattcaaggaaattttaaaaaatatatcatgaagtcatatagctaattaatgatgaaacttttattaaaacccaatttaaagagtaatccagagcaagtgtcaatactgttgaatctaaaataaagactaataaaacaatatttaaagtgaacatctttgtaaaacaagaaatagaaacataagccaatagggtgaccatatttcccagtttgtacaaaatagttccattttatgcttattgtccttgtaattattagtagcacttacgcccttcgctcctttaagtgttgtggtttggagaataaatatgtggacactctacatagcaatgttgtgacatggcatgttagagatctaaggtatacagtaatttgaggacaaagaaaacaactgaattgcaatgtttttctaccactgaggtttcaacaattgcagctgtaccttttccttctctgagacagcacgtcagcatttccttccattttctctatttttagaaacgtaaaattcagctataaaatatggctgttggcagacagtacagacaagagtagaattctgcataataaatctatagttgaaaaatatggattctgtgggcattctatggagttcttgctgttggccatgactttctactaaagcgatctctttaacaagtacctgttcaattcctaattgagctttcgaaggtaaaagttgctctttctgcctgtaatcccaggcctttgggaggccgaggtgggcagatcacgaggtcaggagatcgagaccatcctggctaacacagtgaaaccccatctctactaaaagtataaaaaattagccgggcattgtggcaggtgcctgtgttcccagctactcgggaggctgaggcaggagaatggcataaacttgggaggtggagcttgcagtgagccaagatcacaccactgcattccagcctgggtgactgagcgagactccgtctaaaaaaaaaaaaaagttgccctttcttgtgacttcattcattttatcccatatatataagtaatattcattgagtaaaatgtgtgaatttattttttactgaatctttgagataattttcaaagatacatgggaagtatctttttcaacagcattataggatattagtggtaaaagaaagttcagagattatctaatgccacccttattcaattttcaaatgagaatatagaaactgagaaagcataagtgatttgcccacaatcacagagttaattagtgacagatgaatacatttatggtctcttatgggaaaagacagaataatggaattcttatggttgaagaaacattaaactggataatttgacacctgtaaaagatattcattaaagacaaatttgtgcctgccacacactgatttctgttccaattttctgtcagtctacacttacagctagagctggcaactatcatacaagcagtcaacacttacattcttaaacacttttttgtcaaagtatcatggacatcaaagacctctaaacacatgaatctctaaagagataaaaaccagatatgagaaatctaagttgtacaaagttgttcctttgattcttctttgagccctgaactgacatttttccctaacacttatgctctgaaccatatgacagtccatcaagttgttggtgtttgtctgctttgtcctaattaaggatctccctgtgttctgctgccttgtttaaaatgtcaacaaaagctttaaatagcactgtatctcagtgtgtgcactcattattaattcaacatctggatcaaagtaaatgatattatatcttactgaaatatgctttgttttttcttattaagcttggcagttagatgattgtcaaaagatgcatgctttattaaaacgctttaagcaagaagggtatatcttagtacaaaattagatagaacaggaaatccattaaggaaatatacaacattttgattttatatttccttgaatctctacacatagagttttctaattttttttttcttaatttgatgactaggacttgttaaattttcaccaattaattagaaaataaaaattttggtaaaatgactctgatgaagcacaaaatgatatgcacttttattgttttatttggctaatggcacagtttagcatgtccaatttttctctaaagccttatattctctgtggcaccaasagcagttcattaccccaaaatggagctcagtatttgtttcacaaatagtcttaccaacaatcgccaaaataatgaaaatattattgcaatatgcacaattatcaaaagaattgattagatataattaattcctatgatttctcagtaatgtgaccttactatgcattaagcaatgacctggtttccaattaccaaaaacttcattgccttctgaatgtagatatatggcattttgtgatgtactatccgttgattattaaaaattgcttcagcaagtttcaggaactatgtctgtgttctcaaacagaaattaaataatatactactacagattaaataaatgccttttaaaagtatgatttgaggagatgtcagcaagatgataaaataaggctctccagtgctccctctctcacagaaacatcaatttgaacaactatccgcacacaaaaataccttcacaaaagtgaaggaaaccaggtgagagatttcagcacctgggtatagcacggaaacaagaaaagatgcactggagagagaggaaggacagtttcacattacctgcttcacttttcccccaattaccagacagcacagcatggagacagataccctccacatgatggtaggagaaggaagtgagcatcagactttgccttagaccccaacactgggcctgccacagaaaaacccagcaccaaagagaccctcacagccctagacaccaggctagtacttgtggactgagcttccacacctttcccagcactgatcaggggcttatagccttagactcaaggtctatacagcagacttggtctctgggccactctactgccaggtctaccttagcagcccagcctctggaacttctccagcactgggctgtcccctataatcctggacatcagatccatcccagtaactgactatttcctgcagactcagactcaaagccaatcccagagccaagtagccccctgtggacccaaggataaggccagcctctacagatgtaggcaaatatttgcagacataggcgtcaggtctgcccttgtgtacccaggtttcaggcctatccatggggactcaatcaataggtccacacttgtggatctagacttaggcccaaccctatagacccacccacctgctgacccaggcacccagacaccaagcccagccaacctacctgaggactccaacagcaggcctacccttagacgacaccaaatggcatgcacaggttctatggaaaggctgactgataaagagttttcccagacaaagccagtctgcaaagactggaataagcccttacttcttcagatgcacagacatcagtgtaaggaaataagaaacatgaaaagctgaggtgacataaaccaccaaaaaaatacaaaaatctcccagtggctgagtcaagagaagtggaaatatataaactaagagacaaaaaagtcaaaataattgttttaaggaagctcaacaaacttcaaaaaaattacagggaaacaatttcataaaatcaagaaaacaataaataaaacaaatttaatagagagattgaaattatttttcaaagacaaagagaaatcctattgccgaatataatgaatgaatgaaaaatgcaatagtaggattgatgaaggagaagaaagaatttgtagccttgaagacaagttatttaaaaatatatggtcagaagagaaaaaatgaaaacaaatagagaaagtttatgtgatttatgggagagcatcaaaagagcacattttttagttcaagaagagaaagacaaaggggtaggaagtatgtttaaggaaataataacagaaatgttttcatatcttgggaaagacatattcacgtagaggaaagttaaagttctctaatcagattcaattcaaacaagattacaccaagatatatcataatgaaatcaacaaaaatcaaagacaaagaaaggatcctaaaggcaccaagagaaaagaagcaaataacatttaagggaatgttcctatcaagctagcagatttttcggcagaaaccttacaggccaggagtgtatgggacaacataatcaaaatgttaaaataaaataaaaaaactatcaattaggaatactgtaccccacaaagttgtccttcagaaaaggagagataaagtctttccacaacaaaagttgagggagttcaccaccagacctgtctcacaagaagatgcttaagagagttcttcaggctaaaagaaaagcattctaattagtgacacaaaaacatgtgaaagtgtaaaactcacttacaaagataagtacacagtcaaactcacaacaccctaatactgtaatggtggtatgtaattcacctatatctttaccatgaaggtgaaaagaaaaaaactactaagaataacaatagctacaataatgtgttaaggcatctacaaccacctgatcttcgacaaacctgacaaaaacaagcaatggggaaaagattccctatttaataaatgatgctgggaaaactgcctagccatatgcagaaaactgaaaccagactcgttccttacaccttatacaaaaattaactcaagatcgattaaagacttaaatgtaaaacccaaaaccataaaaaccctagaagaaaacctaggcaataccattcaggacataggcatgggcaaagacctcattactaaaacaccaaaagcaattgcaacaaaagaaaaattgacaattgggatctaattaaactaaagagcttctgcacagcaaaagaaactatcatcagactgaacaggcaacctacagaaagggagaaaatttttgcaatctactcatttgacaaaggtctaatatccagaatctaccaaatttacaagaaaaaaacaaacaaccccatcaaaaagtgggcgaaggacatgaacagacacttctcaaaagaagacatttatgtggccaacaaacatgtgaaaaaaagctcatcatcactggtcattggagaagtgcaaatcaaaaccacagtgagataccatctcatgccagttacaatggtgattattaaaaaggaaacaacagatgctggcgaggctgtggagaaacaggaacgcttttacactgttgctgggagtgtaaattagttcagcaattgtggaagacaatgtagtgattcctcaaagatctagaaccagaaataccatttgacccggcaatcccattactgggtatatatccgaaggattctaaattattctgttctaaagacacatgcacacatatgtttattgcagcactatatacaatagcaaatacttggaaccaacccaaatgcccatcaatgatagactggataaagaaaatgtggcacatatacaccttggaatactatgcagcaataaaaaagaatgagttcatgtcctttgcagggatatggatgaagctagaagccatcatcctcagcaaactaacaactagcacaggaacaaaaaaccaaacactgcgtgttctcactcataagtgagagttgaacaatgagaacacatggacacagggaggagaacatcacacaccaggacctgtcagagggttgggggcaagggaagggagagcattaggaccatacctaatgcatgctgggcttaaaacctagaagctgggttgataggtgcagcaaaccaccatggcacatatttacctatgtaacaaacctgcacgttctgcacatgtatcccagaacttaaagtaaaattttaaaaaaaagtgttaagggatacacaatataaaaatatgttaattgtgacatcaaaaattttaaatgtgggaggaatggtggagtaaaagtatagttttttaaaaatgcaagcaaaaagttgttatcagcttaaagtagcttgttataactataagatgtttttgtaattctcatggtaaccacaaagtaaaaatttatggtagagacaaaaaagatacaaagtagggaatcaaagcataccaccagagaaaattattttatcagaaaaaaaagacaaaaaaagaggggaagaaatgaacaaagaacctacaaaacaaccagaaaacaatgagctaaatggcagtattaagtccttacctattaataattaccttgaatgcaaattgattaaattttccagtcaccttggatgtgaagggggctgagggaatagaaagaaaagactccaaggtatctcattatccagatgaaaacctggatagaaagtagtgccatgaattggaaggaggaagcatagatttggtgtrgagaggagatatggccagtttaatatttaatatgttgattttgcaatgccaatttcaattccagtgactgttagatttatacatctggaactcaggccagctctatgggacgatgtgtagaattgagccatttatgataattaaaattaaggctgtggtggaagataagactcccagagagaaaagaaataagggctataaagaaaaaatttctgagatgcacaattctaagggaagagagaacaacccacattgagcaatggaggctgcaggagaacaggtgtgctgccaccacagaaattaacatgcaggggtgcagaaaggaaggtgttgtcagcttattcaaatgggcaaatacatgagatacccatttttttggacttggcacctaagaggccactggtgaatttagagaaagcagtgtcaatgtttaaaaagtgaactggagtaattgtgagtaaacaaggactaatgttttatagagacttggctataaagctataagtcatacttccattgctaaaggtagaagtgtagttaaaaataaaggtttgctttgattctttgttctttgaaatgaaagagactagaacatgtttatttgtaagaagtaattgccactggaaactgaaacataggacacacacagagaaggaagagacccacatgcagaaaacaaaggctataaataaaagagtacagtgtcctgggttttcctggatcttgtgtaaatgactccatcacagcattatcatgttttcttctcaacatcttcatcattctactaccattcgtagaaagtggattttcatatattatctcatttagtctttgtgacaaacctcctattccaagtatgcaactgaggcacacaaagatttaaaaatctatgagttagtagcagaggccatatttaaacccaaatctaactgaatacaatgtctgtgttctttgcatttttccaccccaggcttatagttcctactaattcaacctattgaaatatattttaacgttttattaggcaaacaaagcaacagagaacagcagggaaaaaggcgactttatctctagctgacggggctcttgaaatgctgttaatcaggattctagatacaaatttccacgtccactcagaggggcgagaatgtgcaatatattgtgatgctgccaccttgtggcaagaaaaaatgaaaacattaagaggtgctttgtgtgcatatttatcattttcaattaaattgctctagtttatggttcagctacggctgcacattgaaatcatctgggagttttaaaaatactgctgcctagatcccacctcagagattctgatttaattgttctggggtgaggccttggtgtcaggatatttttaaacttcccaaatgattctaacatgcagcaaagattaagacctctgctctaaccacttatacagtagagaagcaagtcttgtcatttgcctagttatgtttcatttgtatagacgcaaaagaaaacattctagagaaagtaggtgattttctctcaatctttaatggcatctagttcttggtagaatacaatgatttctggacagatatatcatatactatgattttaaagaacaggacaaagaaatttgtgaattgtaatcaaagtggacacaagatttgtgtctcataatcaaatgcagtccgtagactaaagtgagcagggagaatctctgagcctcataatgcgtcacaggttttctgaaaggaacaatggaaagagcactgaagcaccattgactctggcactagtaagatgagtgaccttgagcaagtcactcagtttgcaatgaaagattttcatctactgctttattcaagagaaactagttccaaatgttcaacaaatatcataccaggtaattcaacaaaactttcttaagtacttgcaatgcgaaaagcatggaattataatgtgttataaatggaaagcactaatgttgcttagagacatcatagcattaggtgaccagaggaacctttgaaagctagtaatgcaaattttaattatgatctgaactgagtgtaattagaaagcttaattacataatgctccagtggtttggcaaagaagttgaattcagttttctctatttttcattctgttctgtagttttctcagatttatttattagctctacaccatcaaaaagtgtaatcatgtcttgaaaatgaaatttctctttcctgctccttggaaattaaaattttctatggttctttaactgaaaagtttcagtaattgcaccaccaatcacccagtgccttggtcaggaatctttctttcttcattcgttcatttaacacatatttattaaccctctaccatatgatattactcatctttgaattccacctcccttaaattccaaatttaattatttacaattcatgtcaattattagcttctaaacatctcttgaatattctgyccatgtctacagtgatttagattactacagatctatcctcctgccttctagctcccttttctcaactccagtcccacactgcagacagtggccctttgaaacttcaaatctgctaatgctattgccccacttcctagtgaatggcttcccttcaccctaggatagcatgcatggtacatgacaatgcttgggaactccttccttatctggtccctgcttaccagcccaaaataatttctcacccttctccattaagtcactcagaaagcttaaagctttgcaattctctccaccctctcttgaccctgggatttttgcatataccctttcttctgcttgcctttcttcacttggataatttcttttttagcccttcatgttcctgtttgaaaattaatcactccaagcagccttctgtaacccacattactgggttatttttatgtgtttccaatgtacaataagcttaaaatttggaatacgtatcatcaacatttacttatttatcttctcactagaccatgggacaaagaattgagaataaaagacctaggaatccaacttacaagggatgtgaaggacctcttcaaggagaactacaaaccactgctctctatttgtctgttattcgtgtataagaatgcttgtgatttttgtacattgattttgtatcctgagactttgctgaagttgcttatcagcttaaggagattttggactgagatgatggggttttctaaatatgcaatcatgtcatctgcaaacagggacaatttgacttcctgtcttcctatttgaatacgctttatttctttctcttgcctgactgccctggccagaacttccaatactatgttgaataggagtggtgagagagggcatccttgtcttgtgctggttttcaaagggaatgtttccagcttctgcccattcagtatgatatttgctatgggtttgtcataaatagctgttattattttgagattttgggctgagacaatggggttttctagatatacaattgaaaatctagaagaaatggaagcacagtatatagtacatagtagatatccaacaagtatgaaccattgatgaagaacaattatttgcattcaaaaatctacgatatattaactcggaaaaattggtcaggtaaagagatgaaataaattatgacatgtctgacattactcaaataatttttaaaaagtagattccagcttttgatatacacatattagccacacaatcatgggcaatgtgcttaacatccattaacatcctgagctttagtgtcttcaattctaaacacagatacattcattcagcaaatattgattatatgactactaagggccagacagtgttctaggtagttgggatacagcagtgccccaaagagtcactgtctctctttttacgcatcttaaattctagttgatgagacagataataaaaagagatatataatgtcaaacagtgacacatagagaaaaaagattaagaggctagagtgtaacagagtactattctattttttctttttagtttttttctttttgtttttgttttactttttaaactattattagtattatttttacaaacacttgtaccaagggctgactttcaatagatcacagcaaggatcccctctgctacatatgaaaccctgacccagaagcaggtcatctacttatgttttagtgccaggttacacacgaatgtgtgttacatgacgggcaagggggcggccgaagagtactattttagaaaggatggtcataaaaggcttctttgagaaggtaacatttgagcagagatttgaatgaagtaaaggagggagcaatgtgaatatctggaggaagaatgtcccaggcagaaggaaatacaatgcaaagaccctaaagggggagcttgcttggtgtggtaaggaaaccgcaaggatgccatatactggtgcagagtggaaaagggaagcctaaaggtgatatcagaaaagtaggcaggagccagactaagtagagccatgttttccaaactgcagtcatgaaaacaaattggtgtcatcactagcaccttttagtgtaactaagaagagtaaaatgagatagaaaatatcagtgtatggtttttcttttgtgtgtgtgtacgtgtgtgtgtgcacgcacgtgcacttgtacacgcatgctgggttgcaatgtaaaacacccttcttactatgggttatgataaaatttgaaacaacactgtggtagggccttgcaagccatgataagtactttgagttttgttataaatatgataagaagccattggaagatgggaaggtgttagctgaggaattatgtgaatgtaacgtgttttacattttaaaaggaaaattctaggcattctgcagaatggaccacaagggacaagagtggtgctgagagataagtcccagaatattacatggtccagggtagaaatgatgtttgcatagatgaaaggatgagaagtgatctgagtcaaggtatatttagaaagtaagttcagttaagagttgttgaggatagtcatcattttctagagtttttatgaggcttaaataagattggatatcagaaagggttttataaacactagagaagtgctcagcagagtacagctgagttcaattcaaagggcatttactgaccatacactatgcacctgccattactctcactgttttctctgcactcggtagataaaactgaatttctgctcccaaggaactttacagcagtagagttgtggaagatagacataaaaatgaatcactgcagcataatgcacaatatgataatggcatatggaaggttctaaagaaaatgagttaacttaaaattctgagaagcagtagcttttgttgcaagcctttcttttcataggtaaaagatcacattagccccaaggatattctgtaggacaaatatgagctaaaaatgaactagaaaatagctctaggtgaaaaacacatcgaacacagatattgctgagttagtctattaaagccacatgtcatttgcacttttgccctacagtcacaaaacaaaagcaaatgaacaagggaaagaggatcttcagccctcctacataagtaacatgaatcaataaggagtcatcctggagaccacagaaaaccacactcttccagttagcatcaatgaatagccccaggatacaaatccacagtgaatgaagaaacatagctacagaattagaaacattattaaggaaaattgatttgagtatacttcactaatgttagagggataatattatattttaggttgaaatgtaataatttttttaattccaaagtgtctattaattttaaaatatacatactttttgttacaaatatttatttttccccttcataccactaatctctgtgaaaaagtttagaatgtgacataaaggttctaggttaatgaagtctttcaatcaagcataaagacttctgctaatctagtaaaaaccgccccttctacctacatggattcaatatatttgttgcattatataagaaagcatttgtgtaccacatttacatatgagatgtttatcagaaagaaagtggtgctctgaggagagggagatggggaacagaatcacttgagagtgaggatttatttccaattaattaacatgcccacaagaatctgccataccccacatgaagaatcattgctttaatatagattgatgagttgataacgttaatgagttgatgactgtctctcaggtatgttggggaacaaaaaagtttgagaaacaaatacagtcataaagaactatattctaataataaggcgttaccattgctcctactttttaatgtattatatacattattatataatactttttaatgtatttaataaatatatctcatagtggattttcttaaaacagagcttgccttttcattaagtaattactccaaggagtaattttaaaagaaaataagtctaactgagcttttgtgttaacatgataggaactgataacatttccatttttcttatgtcacatagactaaaactgttcagtttaaaatagttcaattacctccataagctttaagaaaaccttctttaataacatcctatgttttcaaagttaattgggtactttcacatttttttcctttaaaacattattagacaggacatttcatgggtaaagattagtgatgcaattataccaccatctctgaatgtcattctttcttcatctccattgccattgaagtccattttgtcatcttttatttcaactacttcactagcttcctaaatcatctttctactattttatcacttcatcagtcagaaagaatgatctacctaaaacacgaatcccattgtgttactccctgattaaaatctgttcccccaagcctgcagcttgggtaccctctgggaatgacttaaaaggtgtttcctgaccaggaccctgcttacatttccagctgcatttctcaccattcccttccctgctcacagtgaattaactcatagttccccaggtgtgtcctggttcatcttctctcctggccattgagcaggctgcttcctttgcctaccagattctactcttccacctccatttcacttggtaactcttgcccatccttttggtcccatttgaggcttttcttcctcctaaaaacctcctatgtctgctataggatgagttatgccttattcctttgtgtttctatggcactagtactatggttatagtatcttacttacttacatattaactctactacaaactactaaataacagaaactatgtctttttatcattagaattagtcaatcttcaatggcagcgtacacttgaagcttaacaaaagtttaagtgaatgaatgtggtggacctgtccaaggtatgatgagactttgagtccatgtcctctaattgttgacccacagtggtttccactgtgctctactgtctcccagtgccatgaccttggtctccacactctgtaactcttggtcctcctcccattgtctgtctacagtcctttgctttgggaaagctagactaagtaaggcaatattttaaattaactaattgcaagccaagttttttgcctggatttgagcttagccttccattcttgggggagctattcattacttaagaaaacctacctgtgactatgcatgtaagaattctggctaggaataaactattgttcatgattaaacaggaatggtgcaagaggcatgagcaggcctacctcagaaaaagaagtggtaacagattgctgtactatgaaaacagcattctggcatatatgtcctgaaagaaagtcaccaaaagttctttacgctaacttagtcaaaaacaacacataccttaggtaagaaattttcagaaaaagtgcttgagggttagctaatttatctctcactttttacagaggaacatcgaaggaattcagctttcaaaatgcacctaaagatagaaatcagattcttcttggaattagaaactgtggggagcatcttttgattgttgattgaactcatgttgttttacatacattatattctctttcacaatatattgtgggtcattattctacaaacaaccctctgagtctcatatgaaacctgcagcaagttatggaagtggcttttatcattcttacaattgccctaccattagaaagggacataataattttattatagcacatactcctggaaagaccataaacttttaatagacttgtaaaaagggagtgtaaccttttcaatattctgtctcatctattctaccttctcctcacatataacgaatgccctagggcctaagtcatggatctacacttgggaagaaaatgttgagattcagccttttccctgaatctgaaggttaccatgatttagcacccaggaatagtttctgcctatcctttttctggttcttttgcagctctgcaacttccagacttgtggtctatgtagagttgtgatgacattccgacttcatgtctatagctttcatttagggatttttaaatgtcagcataaacatcctacagcgtttaaagttgtcttcacatcaccacacatattcattttcagcatcattaatgattacactttctgattattttcctttctctgctagactgtcaaacttcttagtttacttcctaatattgatagcatcaccagctctaagcatgacttctcaaacaagatgtttggttaattttctgtgtgtttttgttgttgttcatttgatcgtctcaactttttgttgcaatgcacaacataaccaccttcttagatcatggacaaagaaacaaacaaaaatctttggagacaaacatggcagaggaaaataaatatcgcaaaggaagtgagtgcttccgaaaaacaaagtggaaacaaagtatgaggaacccctgaaagcctcacagcataagaaaagaactagctacttgaagagtagacagtggctattaatttctatttcttgaaaaaaaaataccattttaaaattgtcagggaccacaagaaactgtttttataatgttaatagtttttttaaatcacaataataaaaattgaaagcataatattttacatttatcagttacttctgcctccaccactttccttaaaaaaagtaggacttttacagatgaaagagcattttaatacaaattttaaaattacccgaagacaataaattatttcctaaaacgtgtattaaatctttttgttatgtctataaatgataatctagtctaagagtaacttatcagcatttttgcagtcccctccccccatccactgaaaactttctttactagactcatgattttcaaaattttaagaattaaatttggagtaaaggaactccgaagatctgaaaaagcctgtgaactggatgtccagaaagatgtaaatacataattattgatagaaaattttgggatgtttttcaaaagcccccagaagttcctctaaggaacccttaggggtcataggaaagctcagtgctgggtagtgagctcctaagagcagagaaatgccctcctgtgtgcatctctagatctggtacagtttcagcattcataggggtgctataaacatttgttacgttgaatcatggaggataagtatgtatatactcgggtgttgttgttgctgttgtttgagatagagtcttcctctgtcacctaggctggagtgctgtggtgcaatcttggttcactgcaaactccrcctcccaggtttaagccattctcccaccacagcctcccaagtagctagtgtaagccaccatgcctggctaatttttgtatctttagtagagacgggatttcgctatgctgcccaggctggtctcaaactcctgagttcaagtgatccacccgccttggcctcccaaagtgctaggattacaggcctgagccactgtgcctggagggtattttttttttaaaaagaagaatgtagtatttaaaagttcatcatgcaattaaacctcattgattttgagagcaaaggagcaaagaaaaatctggcaaatagcaaacctactacttaaagtaaacctttaggaacttaagcagggctgctcaccaaataattctgctgggtacagaactgatgtggcctttaaattacagagtttatgtataataattaacatccaggccttgcagaaaacaatattacctctgcagagcatatcattttctttattgataaatgctctttactgaaaacacaatgatatgaggatgggtaggagtgccttagagctctccttgaacatgtatacacagtggttaagaggagattctttgatgatggacaaaaattcaagtctagtttgattgttttagcaacattacaggtaagcaaacaaggcaggaatgcaaattaccaaaagagttatgcttcctagagattccccaattttgtagcctctacttatctcgaggcaaagctgtctgacagagattctgtcttctgacatactcctattcttttctcttttttattcttcctcttagtataaaatttggtaaattttagttaacagaacatctcacaagttcccaccctgacttctttgcttatttcatagaaggaatsctaaaaaagaaaaatatatatttttttctcccacagtttatggattacatcctatgcagatgacacgttggataatctctttttttccaggatgaaacatattaagaaaataaaatacactctcacaaatgcccactacctcaagataaataggtagatctcacaatatctcagatatcacctaggagagaagaaataaaatcaagtatttggaagaacctgacagaataccttagccatacctcagcctttcagagagcaacaggcatgaaatgttttagaaaaataatttctgttcccttcccccttttcataaagtattctctctcagtgatccattcaaaagattaatagcactcatggtctaaagtgttcaagataaaacatgaaaacaaaaaccaaagcatggattctactagacaacaaaacatgtctctcctaagaatgaacaattcaaccattccagcttttcacacctgagaatcttggattcagtggattctgaatatcccaatgaattaaaattaagatgaacctttctcttcaggaatagaacttgctaaaattagagataaatgagttacatattttcagtgaaatacatattcctattataagtcatatagggagtgaggctcctaaaagcaggtggctaactctatctacaacaaacattttgacaagctcccaccaacataatacatggcatcaaaacaatccgaaggcaattcaaacgatagcttcacgttaagcagctgaggcactgggcaagcaaaatctaatgaagctatattttctctggaaggcaattagtaaactgctcatattttgctgctgaaagaatacatcagcatgaacagatggaaatttagaactccacaaatggaattacagacattgatttaactttccccaagcaaatgaaaaccacaaaatacgaattgctctttctataattaagcacataattagagtgcatcagattcatatccattgtagctcatatttcttcctcctcatttctaaatttatatatattctgagtctaacaaacctacttagagttcaactccacactgaaagagtcttctatgacagatagatggtactaaactatttctcaaattaagcctgccatgggtcacactagctttttcacagcatgacacatgcggcaataataagaaatccaaagactcaaagaggtagtccttgtggcaggacagatggagagaacagctgagggaggaattcagccagtttattaactccatgtgagtagaacaaatcatatttaaaagaattcataaggacatctggtcgaaaaacagaatttaaatgatggcagttttagaatggagaaaagagaatcatgatgtctcacagtacaatatcactgagttacctctttgtttttctacttccaggaaacaaaaggtcaccagtgacctgcacacagattatagaccaaactggtgrtgggcacttgggaaatacttggactaattgtcaagtttaaaatatacaagaaatactaaaacatattatggaaataaaatcactaacatgctaaacattacagatacttgaaattattcacattgttaattattcttttcctcattctaggatacagtagtttgtcttacttgtgaaaatatttaggggaacttagataaaatttttgtttgatattcctaaaatgctagaaatgacctcagaaatctttttgagaataagccctttataaaaacctccaaataggtctttcctgagaaaactcaattgatgtgctttatcaagtataatagtatgtttcatttataagctttccaagttgaaatccaaagtaataagcatgtttcaaaaaaaatctaaacaagtaaaaatggggaaacttactaaaactgtgcacacatatatagcatcaagaaataaactagcagtaaaatccaaggtcatattcagtgtgataggcactgcagatcttttctattaataaaaagcaacagaggctttttctacccatgaaatgtttttttaaaagagctttcttattattttagtgaaatgaagtttttccttcttaataaaaattttcaaatttctaccaaaaaaaatccttaagtaactcaagttttgcagtttatgcttatttaaatatttgataggtattttctgccacttgagagttgctattaaattttatataataaacttcacttgcaaactgacttccttctcagacaaatcaaatgacagcaaacaaaaataatgcctattaactattttaagtacattactgtaccctgtggggaaaatcaggaaacaaaaactgtagtttcagaatttcagatggattagttattcagaaattgtcttgaggacatgccctaaccttttgatatcactcatcaaaggaaaatgtgactcacaaagactttaatcccctttcctcccaacgggagatacagtctgtatagagagctgtttgcatttataactcayttaaatcatgtcttccagatacttcaggtttaactcacagtgctacactcaaactaaccaatttaataaaaggattataaaatatttgaagcaaacttatgcatattttattcaatggtttatctccaaacagtagatatctactgatgaactatttgaacattagatgcatcaaattcatattcattgtagctcatatttttccttatcattcctaaattcatatatactgagtctaacaaagtacattgcttctagttataatcaaatatatttataagtctattcttcaccatgttgtttcaggaatttattatggattcaagagaattcagtaaaagacaactggttaagccacagttaataaaggtagaaacaatgcaaacaagaactcattcatggagtagatttaatagagcaagtaacacaggatattcataatcaaatgatattagcttttacagtaaaaatgtatttgagagaattaaaagtcagtgataataaggaatgagaataactccttcccatcatcctcagtcatgtgaactatgctcaaaggcttcagatggtcaataaattaatacatgaatctttaaaatataaattaaatatttttatttagttgctatagtaaatagaaagatttaatttatagtttaaagattgtatacttttatgtttagtatagcaactttaggattctttggttttcagtaataatctatgcatttgggtaaccaaacttagtcagcttggtcaggacttttttgtttatttattttattttattttattttattttatttattttttttaagacggtctcactctgtctcccaggctggagtgcagtggtgcgatctcggctcactgcaacttctgtctcccgggttcaagcgattctcctgcctcagccttcccagtacctggcactacaggtggctaatttttgtatttttagtagagatggggttttgccgtgttggccaggcccaaactcctgatatcaagtgatccacccgccttggcatcccaaagtgctgggattacaggtgtgagccactgtgcccagcaggacattattttatattcagtcaaataatagtttaaaaatcatagctaaaagtggataagcataacttgttaattatgattcaaagcagttgatgcacatctggttgaagattagcagattctcactgcagtttagttataactgattaacatttcaagggacataggatttcagattctacagtcaggaaaccatacaccaaacaagttaaataatcaagtaaggtagataattcatatttggaggagtttattttgtttcttcaggagatgataagttatcaaagattctcattcaatagaaattgctattaactattagaaacctaccaagaacaataaaagcagggacctgtttttttttcattttttgtttaaaaattcaatgctgaatcactatcatctaggtcagtgtggaacacaaagtgtgggttcagtcaatatttatagaataagtgaataaatactaaactgttaacaaatagtcaaagcttatgtgaataactctgttggataaaaaagagaaaagggtaagaagtgaagaagagataaaaaaggaagaaataaaaaagaggtgagtgagaggaaagtgaaaagttctttcctagtgaaagaggtctttcctatggcagcagaagagtagatttacagcaacctaaaagaaaacagatggctgaatcctttcaytccccttacgtacatgtggtccaacattgtctcaacaagactgtagccctacaaccaacaatcgaaagagtgacatcaacacataaaaggaaggaagtgcacattcagtggaaaccccaatgagaaatacgcttctgccaagactatcaggttggtatagtacttgcgatgtcttggcaagaaatcatgaaatacttgaagaaattaaataattattagggggatgcttacttcactttactaggggaggtccttgagtacctcttctaacatctaaagtcttctcctctccagaggaattgtgctccgttccctggttacttctcctttacttagggatttcagaattgtgaataaggaaagaatgacctggtaagtgccagccctggacacatttgcccacagatgctgtcctccccctttctttagttgctctttttctcagggggctggactctattaggccatatttcccagatttgtctgtcagttgccttaggkttggtctcagccaataggagggagatatcaccaggagacagaggggagaatctaggccatttctccccacccttttctctagaagcagctgtatcttacctgtgttagtgactctagctcccattggacaggccattactacctgggctccagtaaatcgccccctagctctcaggttggtagtggcttcccatttttgcttatctctgtgttggtccaagagtgtctgcttttgacttctgcattgcaatatgagaacatccttatctctgacacctttaaataccccttagggtctcatctacttagatctctgatcttagaccacatgtctctcctgactrcccagctggtcttgactgcttggcctacatatctgcatcagctgtctctctggaatgcccagatcaagctctggaacctgttctactttgaccacaggcttctgattcccttctctctttcttctgatcccrtctagctctattccattcacttcatcatggttgctggtcctatagctgctcaaagttgaaaagttgctactctgaatgctgatgtttgctgaactgcaggacaaaaccactctataattatctctaagttcccacttcagatttaccttgaatagattttaggcataataggcatacacaatatcaaagtttacatatttgtgtcacaagaagattaaaaataaagtatatttcccacatgattggtcatcccttccatgcatcctctttggtaatatccagtaagatataatggcagacaagaagatggataaaataatgtcagatagtaactctgctcacagggcatggaatctatgatggccttgtaataaaatagcttaatatagccaggttaacttgtttctataaattctttcaccgtaggcaaaaataacataatccctaaagtagtgaactagtaaataataataattaagcatttaagaccctcttaatcactttacattataaacaaacagtaaatgtgtaatagtgttgactattctgggctcatgtttcttaagtgtttattttaattgaacttcagcactaatacatgtaactgttactctgtttcccaggttatactctccctgggaatctgaagatcatgttgtttaattcaggatctgtatcggtagattaaattcccacccaaccctgtcccaattcccaaattaatcttgagttaggtgaaaaaataacaagcaagctcagcactggccctgtttaccaaatcaccttccagccaaattggttgaattagttacaccttttctcttagtctagtggaggatgtcgtgtgtccttagattcccaaacaaaacatgcccgctctctctctgtggtctacattatagctggagtacaatttccaggcctcatttccagcattctcttctggaactttcatttggctgccacacagaaggccctatgtttcctgccagctgtcctctgggttctcaagtaccccaggttcacctactagagaaaagaattccaaaatgccagctgcccaagcagctctacctgcctctctgccctgattcccagagtaaggtttcagccattaagaactgtctctgggcatctctgaaacacagccttcaacacaatggtctatctggttgatcaccactggccatgaagcttggcctcaacgcctgtcccatcttaggggatggttctaatctcaggtctagctccttccttttagtcaagaattgaggaatcatgaagtgttctctgactccatatgtttgtactaggcttcttcatgatgatttatttgagttttgatgtacttggttttggctgaactcacatctccctctcctgctccctctccctatgcccttgcaaggaacaagaactacaaaatggagccttttgtaaggccgttgcactcaggagctttcttgaagtgctctgaaatttctggcagaaataaagctatttaaaaaaaatagttacagcttatgttcctcttcttctgtgccctgagaaatagttaatcaactcttccttagcttggagttcacccagatgctccttaaggcttatctgtagctccactctcagtggtaaagccaccactggatcctagcagggtgcctaaactcagtaatgtggtaagagataaggcaacaaagcttcatgaacattgtattttcttccaacagggcacaaggaagatattaaactgagttccccccaaaatcccaaaaatctcctactgataatcaagatttgtggaatctataatgtgtctttattttggtttaaactaatgacactagattttcttctacctggcaaagaagaggtaggtatacattaaacaaaagaaaatgaaaaaaatggacctaaaatcatgtgggaaatagatcattgtcatcattgttcaaaaaagaaatgttgtggaatatttctgcaatttcctggccagctagtctttttcaccagacgcatatatctttttcaaatatcaaaagatagtaaagctatgcatgtaaaagtcataatagtaatagtaattataagtattataagggtaagaataatttacatgattcttactgactcccaagcatttgctaagcactttaacttttcaaaatctcagaatgctatgctgtacatatgataagaaaggagaactttcttagtttagaaaactgagttgcagaaaggttaagcaacttgatcaaagcaaattagtaatgggaagagcagaaatttaaacctaactcatctttcatacctatgaagatgcaaataagtcaaccaattacatttgtgtgtaatatatttgccctcttgatgaatactgaaccagagttagagcatcttctatttgtttcatgaaaaagcattgacattatacacgatttgtgtgttctactttgaaatcacactttgttactctaaacattatttgaataagaagttgctaataatttgagcagttatttcaaaatatttatgtactattactacacagatggattactcttgagcttggcatccaatttttaaaattttctaactcatgtgtacatgactaattttccctctcagaattatgacaacattcattcatatgctcttctctcttgatttttgtactttggtagtttgggaaacatgataagatagctcgtagtataactaatagcttagcacacatagcatatctatactcttttgacttttcctctaaatatcaccttatcatagtttgttctttatcccctatccacttgccattatttccatccaatgaaacttatttttcttctctctcatctttgaatttccttccctccctaacagcatgtgagttacttgaaagctctttgatcagaataaaaatcccaattatttgatacttccatttatttggattataaagacatacgggggtatattttgcaaaacagtcttgtcagccccggcagaagatatatcactatattatagctttgccatgtgtccatagagaaaggttatcttatgttaaacacatgttcatatgcaataacagagacatgaattctaaggatattgcagaaagcatagctgactactgattctagcaccttcaggatctttctcttcttagttgygaccactgtaatgcacttcatagagtaataaattgttcttgccctgggatcatgattcccatctcttcactacaacatgtctagatgtaagacatgtttacccttgtataatcaatgatctgagtctagatgtcaagtacttgcttgttctgtgcattaactgtcttctttttctggaactgcaggctctatcagatccttcccctaaaattcatacatcctgccttgttactatccgtgccccagcatgaccaatatcaaagtggttaagaaaaaggctccagctattttagtatcctaaattttatcttttcattctacaaagaagtttttcataaaaagttaaaataaatttaaaaactcattgatactattcagtaagatgttatagattccaagcaactatctcttttataggcaacataattaaaagtgaattacaaatgcagactttatgactctaattaaactctaggccacaatgcattaaaaacagattatacatattaagttagatataagaaaaaataaatatgccacatagtgaggcataagttaatatgcctcaaaataaatgaggagaaacaatttcagataatacatatttatataaaatgtttatcaacataacctaaaatattttcttgaatttcatcagagataaaatttttatacttaatttttgtaaacatatacatcatactttctctcacttacttcactacttcattccatcccaagaacatctgtgcaagtatttcccaagtgtgggagactggaagaggttctatattttggttgtaagaatatatattaatttttagaacattataattaaactcagaaatatttaattgtagggatattatttggtaagaatcaaataaaatgactaaaaattaacttgaggcaacatgaaatctcaacatcattgtaaaactaagagagcagatcttaaacaaaatgtagtgcagtcttcacacttgggagattcattaatcacttaagtgttttctctgaagtttttaaatgcttaaagattgggttacattatgaaaaggacctgtttaatattgtgtctgtaaagttcaattctacctagttctcactttctttcgtatcttctctagtgaagaatgaagaaatgagaattatgtgtttgaatctagcacctctgacatggaaaaacacatggtgaagcagaggaaagaaaactgaaagaaagtgaaaatatctttaagaatacyttggggaaacaaacagtatttcaaatgaaagattaagaacaaatccaaacaaatggattggaaggtattatgtaaaaaaatatgagatgctttagcacaggtactctaagaatttgagaagcttctcatgtttaagggagaaggtaacattcctgatagaaacatttaaaggcagtgcagaaaggaaattctcatcaggaggcctatagaacacacatgggcaacagcaagccccccttgccctgctcagccctggatccatacagaggaaaggagagaggtaaagatgaaagaaagaggttgaacagaagatagtaaatggttgaaaaatatttttaaaatagaaagagttatgcttctgagaagattctccatgtctgggtatcagacatggagatacatcatactgatcaacctgaagtaatgtacttactgaaatacccacttctagttcatcwagttcatgcaaggtttcacaaagccaccaatcgttttaatcatcttataaaagctttctaattgaaatattcttaagtatcacattttactagtggcaggtatcttttcaaaaaaaaaatacaagctaagcaacttgtcctctgttgtttcctaccactaagtttgcattagaagagactggcagtcaaacacacaagaagaaacacaagtattggcaatttaacagaaacaaatggtagtgtatcatggacatctaaggtttgtaggactaaatcataccctcttctagtaagtcctgaaaaaaatgtatttaaaacatatgttgaagaaaatagcttttagaggggcagataataggctttggacttagaaattttataaaaatccattgtgcattctttaggcttctagtcctattcagtttttgctatgagctatgatttgtttgtggaagcaaagtaaaggcagcctatttcttaccgcctccacttcggctgggtcataccagacgttgatgtagggatgctgtaaggcgtcgtccactgatattctttttgctgggtcaatcactagcatctttgacaacaagtccctggcttggctggctgaaacaataaatgagaaaaacaattagtaagattttgatttcagtaaggaaatttgtcagagaggaaatttaagaaaacaaagtatggaatagtatcttccttccaaacatcaggtaaatcccttgatgtgatggaaaagaaaatgcattttacacctgtttctttgtgtctctaagcctaaggcttcattctgaggctctccaagggttgtaacactttgggtatataattattcacgcaaacttcttagtaaaatgtatcaacctggagagtttatgtaagcaaagtcatcttctttggtaacctgcatgaatataggataaacagaataaagagcacagagtgcaaatgcatgatgttcaacaaatgtgtggacggctgtttgaagttaatcaacacgtgtgtctctatattcttatttatacaacggaattatcagaattttagtatataaattgacttaagagtttgtatcatacaaatttttcttttctttttgtttttgtttatttatttatttatttatttttgagacagggtatccctctgttgccaggctggagtgtagtggaatgatcacagctcactgcagcctggaactcctgcgctcaaaggatcctcccatcccagcttcccgagtaactggaactacaggcatgcaccaccatgcctggctattttttctttctttctttttttttgtaaagataagatctccctacattgcccaagctggtctcgaactctgggctcaaagatcctcccacctcagcctcccaaaatgctgggattaaaggagtgagccactgctcccagccacaaatttcttatatacataaaaacaatcaaagaattgaagtgatagaaataatatcattcaactactgaattttattttaacattctgtaatcatcaggtatttttaatcaatggaatcatgacttgatgaaatccagtagttaaagactgaagccagtctaatgctacaccagacactaatgagaaactctatattatgtaaaggttatcataattaattttatggttgtgggcagtaacagttataaaattatatggtgatagctatttatttagtaagattgttaaaagacacattaattttaacctctaaaaatatgtaaattttttaaattattatactttaagttctgggatacatgtgcacaacatgcaggtttgttacataggtatacacatgccatagtggtttgctgcacccaccaacctgtcatctacattaggtatttctcctaaagctatccctcccctagtcttttacataaagttttaacagaaatgaatatctcaaatcaatattgttactcaactgatctgaaagttgaaccgtgaaaatattcagtttattctaactatatggtaaaacatcaaattaaagataacaaaatttaaatggatttttcaaaaaatcaacatagatgactctggatacatatcaatttttatttaatcaatttttcagattaaaacaacttggctaattctacaaatttgaaaattatataaaatacaaaawtcaggaaataatatctaaccccactagctagaggcaatgactgtgattattggcatattttttctagtgccgttcatgtatttttcacgtaatattaaccatactatagttaaaatgtagcaattaattttttacctgtaagtattttcttggtaattacatcaataaatatatcttttaattttctgaacaaatatgaaaaatcactagttaaacttgagaattttttatttctattaatcatttttctgggaaactcaatcctagaaactgattatcattactttcaaattaaaactctgtaccgcacaggaataacaaaaatacagaaatacttatacattaattcaatatttaatttttctcattgccaatggcctcctaatagcctaacagggctgtgtttatttattcattgctttaaagacctctttaatttgtaactgattttacatccaaattcatgtaccattctcataagattctctcatcaaatctatccatttttctgctcttagaaagggctggggttagccgggcgtggtcgtggctgacacctgcaatcccagcactttggaaggccgaggcaggcagaccacgaagtcaggaggtcgagacgatcctggctaccacggtgaaaccccatctctactaaaaatacaaaaattagctgggcgtggtggcgggcgcctgtagtcccagctactcgggaggttgaggcaggagaatggagtgaacctgggagacggagcttgcagtgagcctagatcggtatcccgggcgacagagcgagactctgtctcaaaaaaaaaaaaaaaaaaaaaaagaaagggctggggttacaatggattcttcatgaatagggtcatgaactacaccaatacaaaatcatcttgctaagaaacaatactatttttaggaaacaatatgggaaaatgtttcaatgctttatctttcattctttcatttgaaagcaaatgtgttatgctcttttccaaacacagtagaatacattcttctctttggttatttgtatattaagattatttataatttgccaattttatattaaaaattaaattcaataatcaaatatgcaaactagtttatcatttacaaacataattgcagagattcaaattgatttaaaaagtaaactcaagaaaattggaattacattatgaagtataatatatatctattttttgagacggagtcttgctcactctatctctaggctggaatgcagttgcccgatctcggctcactgcaacctcttcctcctaggttcaagcgactctcctgcctcagcctcctgagtagctgggactagaggtgtgtgccaccatgcccagctaatttttttatatttttaggagagacgcagtttcaccatgttggccaggatggtctgtctcgatttcctgacctcttgatcctcccgcctccgccttccaaagtgctgaggttacagacttgagccaccgcccccggccctgaatatccagacaattctaaaatccgtggctactcccctttgtaggaacgatctttgaagaaatatttctttaacttgaggctgtgccaattaaagaattgatcaatgttttaggtgatgggttatgctaattgctctgatttgaccattatacctctatacatgtttcaaaaataccaccctatatcccacaaaaatgtacgattatcatgtgtcaactaaaaataaaagggaacaaagagaaagagatagaggtctctatactgtgtgcttgtttggcccgtcaccctcatagttgtcctcaagtcattcctgaagggcatacctttgagtttattgtgctcggagtccgctgggaagagggaatctgggaagagtttggggaaggtgagtcccgcatacttgggccgattctccacatagtttcttactgtgggttgcaatttcttcatgaattctggacatggtgttcctagttgttcaattaccttattccactggtcaatatctgagaattgaacagttaagggaaaaaagaagagcagaccactagcctttcaacaattgggagactaactcttctcaaagtcctcaacagtcattaatgcaactgtagttttaataagcaacaaagaatgaaaatataaaatcagacttgcaggctatgagtcttcttgaaattttaaattcacttttgaaacttatatacttttggaaaactagcaattatttaacaaaataagatatcatgaaatagtctttggggtgtacagataaaaagtcattcagataacacaagatgaatctcatattctgcagataaacttctatataaatcatgtgattcagaagaaaaatatataatgacacatcatagtgacatttttatcctgaagttacctcaattatttatatttttaaaatgacaaatacacaaatattttagattatattcatttacattttcctaaactatctttaagatattttttcttctctaaaaatctggaatttttttctatttttatgcatatcaacataacttttatagtaaaacaactcattagttctttgtcagattcctaaaaatcatatttattaaacaaagaagccacctatttcatacctattgttttactgatgatatcactgaatattgttttcaatgaaatataagggtgaacagaggaatattcaatttaaaacaacagatttctatccaagtacatccaagtttagaaagtacattaagcatggggaataccacagaaaaaatattacctctctatgaaaattaatacccttttaaattggagctagctctttttgcagacatactcaatgattgagattctcttttttatctgtcattaatattcgatatatcagagccttgataatgataaacaccatctactctgaagaaycaactggaaacaactgatttaaacagatttcctcgccatgtgccagtgaataatagagatcttggaaattcccttaaatccaatactgcaagcagtattctctcctacattgcttattcttctacaactgttctttggtgttaagttagttaactcatttccactaaggtaaggtgtgacagttaagggactc

SEQ ID NO: 3 - DNA, 147300 bp, Homo sapiens
gaagcgctgagggccactcaccggccagggacgcgaagagcgcggccgccgcgctgagctgccggggcatggtgggcgctgggcgaggttctgcagcgtgcggcgargtccgggcaggccccgaatcggtgccagagaaacctacctgtgccggagaaacgaaaccacctgcttatgagaagcagccgaaaagcccgcccagggccgctgggcggggagggaaactccgccggccccctcctacccctacggagcagggaggggcggggactcggcgcagccgccggggcccgggcctctgggaccgtttaccgcacgcgcgtggtcccggcagcgccggcctcctccgctcataccctgggtctcctcctttctttttcttttctttttgagacgaagtctcgctctgtcgcccagggtggagtgcagtggcgcgatctcggctcactacaacctctgcctcccgggttcaagcgattcttctgcctcagcctcccgagtagctgggattacaggcatgcaccaccacacccggctaatttttgtatttttagtagagacggggtgtcaccatattggccaggctggtctcgagctcctgacctcgtgattcgcccgcctcgacctcccaaagtgctgggattatagacgtgagccaccgagcccggccagggtctcctcttttatttcttttctttttatttcttttgttttgttttgttttgttttgttttttgagacaaagtctcgctctgtcgccaggctggagtgcagtggcgggatctcggctcactgccctggttcaagcgattctcctgccgcagcctcccgagtagctggggttacaggcgcccgccaccacgcccagctaatttttgtattttagtagagacggggtttcaccctgttggccaggctggtctcgatctcctgaccttgtgatccgcccgcctcggcctcccaaagtgttgggattacaggcgtgagccactgcgcccggcccagggtctcctcttttctaacagctcgggtacctttctgggaacccagagacgcttctcagccgggagaaagccagccactaggcgagcaggagcctaaaaacccctaagcaccctgactccatgtcttcccagggagtctgcggcagccgcgctccacgcccaggcctcgccaggaccgcggtttgcgggaagcaacaggagcacagcccagaggcgctaggtctggctgggagctcgcgctgccgactccccggcgtgcggcgtcggggaacctctaggagccttggattcttcagctgtaaaacggacataataatgcccactcccagtgtgtttttttattttcttttttctttttctttctttgtttttgtttgtttgtttttgtttttgtttttgagacagggtctcactctgtcgcccaggctggagggcaatggcgtgatctcggctcactgcaaacttgggttcaggcgattctcctgcctcagcctccacagtagctgggattacagatgtgcgccaccacgtccggctaattttttgtatttttagtagagaccaggtttcaccgtgttggccaagctggtctcaaactcctgaccccaggtgatccgcccgcctcggccttccaaagatctgggattacaagcgtgagccactgtgcctggccccaggtggttttacagaccagaaaatcctggaacaaaaaacacacaatatcgttttttttttttttttggagtcagggtctcgctctatcacccaggctggagtgcagtggcgtgatctcggctcactgcaacttcgacctcctggcctcaagtgagtctcccaccttagcctcctgagtagctgggaccaaaggcgcgtgccaccacgcccagctattttattttattttatgtagagaggaggtctcgctgtgttgcccaggctggtctcgagttcctggcctcaaatgatcctcctgcgttagccaaccattgggattacaggcgtaagccacggcccacggctcaacaacgctgacaggcaaccttttaatgtcttatctccttcctctattaattggattgtctgtcaaaacaacgatgttttgacagggcttgagtcccagtggggaatacacatttaagcagtatattaggasaccctccttatcactagattgagggctttcagcctagcctcaaattattttctgaaaaataactttggctacaactattttgtcttactatgttgctccaaacactaatcaagtaaacttaaccaaagcttgcagtgtgtttcagaatggaatttttatggtgaaaagtgagggttaacttgtgccagtcaacctagtttcagcaactacctgctttctgatctttgagacagtttattcaaaagacgataattaagtgggtatagactgtgtgccaggcactcttcttattccatttaagcgccatagccactctatatggacactgttgttattatcgctgccccatttcgcagatggagaaactaagcacaaagaagggagttgcccagagtcacttagataataaataccgaaacctgaccataaatcttgtctgccttgagagtctaggattttaagcacatagccgggcgcagtggctcacgcctgtaatcccagcactttaggaggccgaggcgggcggatcacgaggtcaggagatggagaccatcctggctaacacagtgaaacccagttctattaaaaatataaaaaaattagccaggcgtggtggcaggtgcatgtagtcccagctactcgggaggctgaggcaggagaatggtgtgaacccaggaggtggagcttgcagtgagcggagatcgcgccactgcactccagcccgggcgacagaaggagactccgtctcaaaaaaaaaaaaataaataaaataaagctgctcctcttaccctggaaattccaagggatttaggagctctgtttcaggaaccagggtcaaagaccaagtattaaaacaaaagattctcctagaactctggcatataaggattttaggagctctgtcttagaaactgggacagagaccaaagatatattattatatcgcagtatcatagtttattattttcaaaaaacgttttctggctggtacagtggttcatgcctataatccaagcactttgggaggccaaggtgggagggtcacttgaggccagaagttcaagtccagcctgggcaacacagggagaccctgccactattaaaaattttttaaattagctgggcatggtggcacatgcctgtagtcccagctacttgggaggctgaagcaggaggattgcttgagcctgagaggtcaagactgtagtgagctgcgatcaagcgactgcactctagcctgggtgacaaagccagaccctgtgtctaaaaaaaagaaaagaagaggaaaaaaaaaggtttttatttcaactaagttgttggatttattagcataaagcttttcataacaatcccttgtcttacaatatctgtagtataggtagtgatgtcacttcttttattactaatattaataatttgtattttctctcttatttccctgctaatattaataatttgtattttctctcttttttccctgataagtttggctggaggttgatcaattctattcatgttttcaagaaaaaaaaaaaaatttcatttcatcgagttccttcattgttcttatgttttctgttttattcatttctacctgatctttattattttctttcttctacttaacttgtgttttatttgctcctctttcaatagttttcaaagatggaacttgcctgggatatcccagcactttaggaggctgaggtgggaggatcacctgaggtcaggagttcaagaccagcctggccaacatggtgaaactccgtctctactaaaaatacaaaaattagctgggtgtggtggtgggcacctgtgatcccagctactcgggaggctgaggcaggagaatcgcttgaacccgggaggtggaggttacagtgagctgagatcacgccactgcactccagcctgggtgacaggagctagactctgtctcaaaaaaaaaaaaagaaaaaaaaaaagatggaagttgaggccagtggtataaaatctttcttcatctctaataaacaggtttactgttatgaacgtccctctaattactactttagttggatcccacaagtttaatatgttttcattttcatataattagaaagacttcctaatttccttttgctatctcctcgactcatggttatttaaaatagcattatttcatttccaaacatatagtttttcagatatctttcttttattgatttttaattccactgtggttgaaaacataattatggacttaaatcttacaaatttattgatatttgttttttgaccaagactatggttggttacattagttttcaggactgacataacaaagtgccacagactgggtaattaaaccacagacatttgctttcttataattctggaaaccagacatgtgagatcaaagtgtcagccgggttggttttttctttttccttttttttttttttttttgagacagagtctctttctgtcacccaggctgggatgcagtggtgtgatctcggcttactgcaaattctgcctcccaggctcaagcgattctcctgcctcagcctcccgagtagctgggattacaggtgcctctcactgcacctggctaatttttgtatttttagtagagacggggtttcaccatgttggccaggttgatctcaaactcctgatctcaggtaatacacccgcctcggcctcccaaagtactgagattacaggcgtgagccactgcacccggcccgggttagttctttctaaggcctctctccttggctagtagacacctttgtttcacatggtcatccctctgtgcatgcctttgtctgtcctaatctcctcttcttataaggacattagtcaggtaggattagtgcctactctttgaactcgttttacctcttaaagaccctatctccgaatatagtcacattctgagatacttggggttaagacttgtattagtccattttcacgctgctcataaagacatacctgagactgggaagaaaaagaggtttaattggacaattccacatggctggggaggcctcagaatcatggtgggaggcgaaagggactttttacatggtggcggcaagagaaaatgaggaagaagcaaaagcagaaacccctgatagataagcccaccagatatcatgagatttattcactgtcatgagaacagcacgggaaagaccagcccccatgaatacattacctcttccttggtccccccctccccacaatatgtggggattctgggagatacaattaaaattgagatttgagtggggacacagccaaaccatatcattctgtccctggtccttccaaatctcatgtcctcacatttcaaaaccaatcatgcctttccaatagtccctcaaagtcttaactcatttcagcattaacctaaaagtccacagtccaaagtctcatctgagacaaggccttccgcctatgagcctgtacaatcaaaagcaagctagttagttcctagatacaatgggggtacaggtattgggtaaataaagccattccaaatgggagaaattggccaaaacaaaggggttacagggcccatgcaagtctgaaatccagtgagggagtcaaattttaaagctccaaaatgatctcctttgactccaggtcttacatccaggtcacgctaatgcaaaaggtaggtttccatggtcttgggcagctccacccctgtggctttgcagggtacagcctccctccaggctgctttcatgggctggtgttgagtgtctgcagcttttccaggcacccagtgcaagctgtcagtggatctaccattctggggtttggaggacaaaggccctcttctcacagctgcactaggcagtgccccgatagggactctgtgtgggggctctgatcccacatttcccttctgcactgccctaagaggttctccttgagggccccacagcttccaccctctgaaccatagcccaagctatgcattggcccctttcagccatggctggagcagctgggacagagggcaccaagtcactaggctgcacacaacatggggaccctgggcctgccccacaaaacccctttttcctcctgggcctccaagcctgtgatgggagaggctgctgtgaaggtctctgacatggccttggagacatttccccatggtcttggggattcacattaggcttcttgctacttatgcaaatttctgcaaccagcttgaatttctccccagaaaatgggtttttcttttctgtcacatagtccggctgcaaattttccaaacttttatgctctgcttcccttataaaactgaacgcctttaatagcacccaaatcacctcttgaatgttttgctgcttagaaattttttccaccagataccctaaataatctctcaagttcaaagttccacaagtctctagggcaggggcaaaatgtggccagtctctttgctaaaacataacaagaggcacctttgctccagttcccaaaaagttcctcatctccatctgagaccacctcagcctggatcttattgtccatatcactatcagcattttgggcaaaaccattcaacaagtctctaggaagttccaaactttcccacattttcctgtcttcttctgagcccttcaaactgttccaatctctgcctgttacccagttccaaagttgttccacattttcaggtatcttcagcaacgtttcactctactggtagcaatttactgtattagtccattttcacactgctgataaagacatatctgagactgggaagaaaaataggtttaattggacttacagttccacatggctggggaggcctcagaatcatggtgagaggtgaaaggcacttcttacgtggtagtgacaagagaaaatgaggaagaagcaaaagcggaaacccctgataaatccatcagatctcatgagacttattcactatcacgagaatagcatgggaaagaccggcccccatgattcaattacctccccctgggtccctcccacaacacatgggaattctgggagatacaattcaagttgagatttgggtggggacacagccaaaccatatcaagacttctacatatgaattttggagggacacaatttaactcataatagtggactgtcytgttaaatgttctgtgtgcacttgagaagaatgtgtgtattctctcattgttggattcagtgacctataaatgttaattaggttaaactaattgatgtagggaaaagaaagagagatcagactgtcactgtgtctatgtagaaagggaagacataagagactccattttgaaaaagacctgtacttcaaacaattgctttgctgagatgttaatttgtagctttgccccagccactttgccccagccactttgacccaacttggagctcacaaaaacatgtgttgtataaaatcaaggtttaagggatctagggctgtgcaggacgtgccttgttaacaaaatgtttacaagcagtatacttggtcaaagtcatcgccattctctagtctcaataaaccaggggcacaatgcactgcggaaagctgcagggagccctgcccttggaagcggggtattgtccaaggtttctccccatgtgacagtctgaaatatggcctcgtaggatgagaaagacctgactgtcccccagcccaacacccataaagggtctgtgctgaggtggattggtaaaagaggaaagcctcttacagttgagatagaggaaggccactgtctcctgcctgcccctgggaactgaatgtcttggtgtaaaacccgattgtacatttgttcaactctgaaataggagaaaagctgccctgtggtgggaggtgagacatgtttgcagtaatgctgccttgttattctttactccactgagatgtttgggtggagagaaacataaatctggcctatgtgcacatccaggcatagtaccttcccttgaacttaattatgatacagattcttttgctcacatgttttttgttgaccttctccttattatcaccctgctgtcctactacattcctttttgctgaaataatgaaaayaataatcaataaaaactgagggaactcagaggctggtgccggtacaggtccttggtgtgctgagtgccggtcccctggactcactgttgtttctttatactttgtctctgtgtcttatttcttttctccggctctcatcccacccgactagaaatacccacaggtgtggaggggcaggccaccccttcaattgatagtatggttcaagaacaaatggtatcaacttaggatggtttaacttatgatttttcaactttagaatggtgtgaagtctgtatgcattcagtagaaggcatactttgaatttttatcttttcccaagctactgctatgggacaagatactctctcacaattctgggcagtggcagcaagcctcagcttccagtcagcacccaatcccaagggtaaacaactgatacagccattctgtttttcatttttagcaaaatactcaataaattacatgaggcactcaatgctttattataagacaagctttgtattagatgatttgcccaactgtaggctaatgtaggtgttctgagcacatttaaggtagactatactatgccatgatgtttggaaggttaggtaaatttaatgcattttcgacttagaatactttcagcctcccaaatagctgggaccacaggtgtgtggcaccatgtgtggctaattttttgtggagacaaggtctcactgtgtcgcccaagttggtctcaaaatcctgacttcacgtgatccttccactctggtctcccaaagtgcgattacaggtgtgagtcaccacacctggccgtgttgtcacacattttaattctttataaattagaaacttcacaacacattgttcttatttaaaatttaaacaattatctttaaatatacataatatataaatatgtatataatatataaatatatacaatatataaatatataagatatattatatatataatatataaatatataatatataaatatataatatgtaaatatataatatataaatatatgtaaatatgtaatatgtaaatatgtaatatgtaaatatataatatgtaaatatataatatataaatatacataatatataaatatataatatataaatatataatatataaatatataatatataaatatataatatataaatatatattatatataaatatataatatacataaatatatataatatataaatatatataatatacataaatatataatatataaatatatataatatatataaatatatatggggaaaaaagcttttatacttactcatgtgattaccgtttcttgcagtctttattcctttgtttagatccttgggatttttgttgctatggtgaccttagttataccaggcacttcaaatcttaccttgtgtttaggawatgggcttgtttgcccaaaggtcttccctaatgtctgctccaccttcaactttaggtcttctctgctgtcagtttctctctccatacacttgtagctctcccaggagtattccatcgttacttgttagtcagtgcttattagcggggtggtgggatctgagaggtgaggtgcttggttgtgattctcagttctgattcctgcaggtactgtgtccctgggycttgaagggtatgaccaagcstctctgtccctccccgcagcagtagttttgggctcagcacatattcctgccccttccccagaatcagagggttttttgttgttgttgttttgtttttcaagtttttgttcctttttctccatctgtgttggatttaccagccccctaggagcgtcagtatttgttacccttcctccaggcttttaaggcctttgtaggagagatgggccaatagcatctgagcatggttttgtgtctttcttgtagcaactgatattcctcacccccaggtctatgccaggaaggatgcttccttacatgcctgtaatcccagctaccggggaggctgaagcagaagaatcacttgaacccaggaggcagaggttgcagtgagccaagatcatgccactgcactccagcctggcaacagagcgagacttcattcaaaaaaaaaaaaagctcttacactcttctgcatattctgcaaagtatactctgggaaggctggtttagaggatctctaacttttctaatatttcataatgcatggctgatgtttaacatgaactcagactcccatcagattttacagatctgggtctgcttttagttctaatgcttcagccagggcactttaatctgaggtcacagcattcccaattgtcagcagtattttgaaatctaagttcctctggtggacaacaggcaacatcatatagccacggaggatctgaacaacttctaagtctgagsgattttatctggtggttttggattcttttccatttatacttaaacaaggtgacacaaatgtcactcacagaaaagccactcttttttcccctgtttttaagaagtctaaaaatgcacaactatttcctgaatgagcagtgtgtccaggtgtagaatagggaatgtcgtgtccactgggaacagacggtgtacctggcacaattttatgagaattatcccatgattcctgtcccaccctgcagcccaccatgggctcagtggggagtctgagtctctgagccccaaagggtagctttttcccagacgacaccagcaagcagagcagcagcttggggctttgacaaggaggctggagtgaaaggtcatattggaccatcctggrtcactggaggacaataccccaggaacctccagcaatgactggtattggaatgactcccctggtcacccacctgtggcaagacatttgcaaacagggtcttcctatgaggcttgtgaggtttggccaatttgcattctgctagaattattaagtatggacatcctcatagatccagaaaagggccgagatccaaaggattgagaatgctttggggggtgtttccatagtgagtggctggctattcaacagtcaaatgtttgagaggatacaagtgatgtgtttcctgaggcaagtggtcagaacccaacagactcttctgttcagctaagatgagagaccatctgaagttcttacatgttctcacagagaaatggattctcatagggaaatggatatattgtgatagacactgtaagcagagaagttgactgagaaacacacacacacacacacacacacacacacacgtcaagactgaatgcatagatgtgtattataaaaagygtaaaaatacaccaccattstaacagattgtgtaggactatattttctttttttttaatttattattattatactttaagttttagggtacatgtgcacaatgtgcaggttagttacatatgtatacatgtgccatgctggtgtgctgcacccattaactcgtcatttagcattaggtatatctcctaatgctatccctccccccttcccycaccccacaacagtccccagaatgggatgttccccttcctgtgtccatgtgttctcattgttcaattcccacctatgagtgagaatatgyggtgttttgttttttgtccttgcaatagtttactgagaatgatgatttccaatttcatccatgtccctacaaaggacatgaactcaccattttttatggctgcatagtattccatggtgtatatgtgccacattttcttaatccagtctatcattgttggacatttgggttggttccaagtctttgctattgtgaatagtgccacaataaacataygtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcatcagtgctctacacgttcagagaaacttctctagtgacgaactatagaaatgatccctgaaagtatagtcttaggactatattttcttttgacttgggaggcatgtttattgctgttaatgctgcaaagggctctacgtgctttaaaaaatcccaatctgttgcattcataagcctgggttggatctaaagcagcctcccacttttggaaaggcatccccacgacctttccatggttgctgaatgcagctggaggcagtcacagctggtgatgtccggagcccattccccactgtgctggtctgcagaacttctgcatgccattcccacaagcaggtctctgccctgctctcctccacctcccttgtcagaggaagtctgcacttcacagctttctggtctcaaccctcctccatccctacagatgtgtaagcagcaggaatcaaaaggtgaaggagagggggcaactcacctccgatggacacgtgaaaagtgggagatggataaaatcaagaaggagcttaagatatccagaaatgtaaactgtgtttggaaaagtaaggtcaggagaagcatgggactcctgaggttgctccctactatcttgcagacttgctgcaggaccaaatgaagcaggatctgtcaagcaccagggccagctcttaagcttagtgcctttctgaaccctgtgacccagcagcctccatcaactcgtcctacctgccatgcacagctcctctgtgcccctgtacctgagctcatgctattccctctgccaggatgcccttctccttctccaccaggagaagaacacttgccagtaagacccagttctaatgtcaccccttcctgacggtatcaggaagagtcagtgatggtgttttatgctcccagagaatttgccacattgtgttgtgattatttttccacatctgtctcccccactggaatgagagcctcactcatcttcatacctccctggtctctacctggtgccagaaccatcctcagggcaggggaatgctcaggaaatagatattgaataaaataagtgtatccatccatccatccatccatccttccatccatccagacatatatacatatgtaaacattctgatggtcaaatggaacaatgtgggctgaagaataatgcaggtagaagaacctaagattacagattcttgatttgggaggaactttattttattgtgcaaacagtctacaaatttgaaacatactctatcaagaaagacactgttgttaggaaagggcgtgggagagggtggccccacaaaacagtgtaaagttctaaagaatttgagaggaacactctgcgggaccctgttccaagggcatctttctaagagtctgtcccttaggctctgcccctttttggccacgttgtcaaaggccttctttatgaacgaagtgagacacattatttttgttttcttgaattctaaagtgattgtcttgagttccctgggggagactcctgggaggtgtggcccactctattccagaaacaaaccaggagactgaagactcatcccaatcccatatcccatgaaaatgtgaaatcaaatcacccctgacaattccaaaactaayggaatcctaacataactctatgtaactctaaagctgagtgtgctggtaattaagcttccagcccacccttcccagctctggggtgcagggtcaccatgggctccttcctgtgtgcaccccaccccacccccactgtcagcatcctgtctccaccctgagagtgacagctggttccagtagcgggagttggttccagcttgccattttcctagcactcctataaccagcctgctgatgcccattcagagacagcagcacgggctggccatgtcccctctccagaattctgcgtccagctcctggaccttgagctctgagcccttgggccacgtgtacmattaatagtgcctcctcctcagaggactaacccccagccctagggccaccttcatatttcygagttttgatattttcaacctcttttctttgttgtatgagtccttgggctgggagcttgcagtcaaaatcttcatgatatctcattatcactacttttttttaaatctctactagctggataacaattatttatattaaattctctcttgaaataactgatacagtgtctcttgattgaaacttgactagtagactaagaattctaactctaaataattctgagggccgggtgtggtggctcacacctgtaatcccagcactttgggaggccaacgcgaatggatcacctgaggtcaggagttggagaccagcctggcaaacatggcgaaacccggtcaggagatccagaccatcctggctaacatggtgaaacctcatctttacttaaaaaaaaaaaaaaatacaaaacaaaattagccaggcgtggtggcagatgcctgtagtcccagctattcaggaggctgagacaggagaatagcgtgaacccgggaggtggagcttgcagtgagccgagattgcaccactgcactccagcctgggtgacagagagagactccgtctcaacaacaacaacaacaaattagccgggcatggtggcaggtgcctgtaatctcaactacttgggaggctgaggtaggagaattgcttgaacccgggaggcggaggttgcagtgagccaagattgcggcacttcactccagcctgggtgacaagagcaaaactccatctcaaaaaaaaaaaaaaagaaaaaaaaatctgacaattaaataaagaacagaaaaaaaatttgaatggcaaatacaaagctgaaaagaaataactgagaataaataactctgaaaatagctcaaaaactaaatacctcaaaaactctttaaaaattcagaaaatataatgttcaaatatgaagtaatgctgaaaatgaaataactaaaaaccaagtaacttgaaaaaaagaacataaaaataaacaactcaaatataaaataactgaaaataaatacctgtgaacataagcaactcgaaaaccagataactaggggaaacccttcattaaaacatttcactctgaaaataaataacttgacagtagttcatgaacttccagtgagtgtttaatagtcaaataagttactgtaaaaataaataactcaaaaactccaataagataaagtgaaataactatgaaggtaaataactcagataataattgtaaagataattaaaaataaattccggctgggcgcggtggctcacgcctgtaatcccagcactttgggaggccgaggcagggggatcacgaggtcaggagatcgagaccatcctggctaacacggggaaaccccgtctctactaaaaatccaaataaaaaattagccgggcgtggtggcgggcgcctgtagtcccagctactcaggaggctgaggcaggagaatggcgtgaacccgggaggcggtttgcagtgagccgagatcacaccactgcactccagcctgggcgacagagcgagactccgtctcgaaaaataaataaataaataaataaataaattccaagcaaattaatttgaacatctgtaactcctaaaacaaaacaactacatataaataactgaaaatgaacaactaaataactttgaaaataaagtaactataaaccagtaactgaaactataaaattaaataaccagaaagctacaaagaaatgaaaatcaactaataaaactaaaaataaaatacaactgaaactaacaaaactcatttaaaaactaataaatcgatacataaaatacctcagaaagtaacttggaacgaactctctctacaacgaagcaatcttggcactaacacgaacaccccatgaacgctcgcagggatgctgggaggcggaccgggagctcccagtctgcggcccccgccgggttkgagcggctccggctcctccaaggctcgggctaagcggctctcaaccgattcccaccccgccctggagaaatgcgggcgtgtctgcaggcatttttgattgtcacgatttgggggcggggtggaggatggggtggcgcattcctggcacctagtgggtagaggccaggggtgctactaaacatcctaccgtgggagcacagagaagcccacgcagcaaagaattgcccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctggttgtcccctttctgccgccgccgaggctccggctgctttctgcgtagctgggcagggcccgggcccccacaccgcctctcccgggaatgcgggcgctctggagccgaggagcgggggcgtccgcagggaggtcagctctcctgggcggaggtcctcgggcgcagcgccctcgcctggaaaccagccgtcgcccccgcaggagccagccggcccgtggacgccccagcgcgctcctcctcggtgctgcgggtcgccctgcaattccgagaagaaagtcagagacgccgtggcccaaagaggcgcttagtctttcctcgctcacactcacgtttcctcctcatcgcgttcttctttttctccctggctgctttctcccctctccaggaaagcagatttggaggaacaggtttcgtgactgtcgtccgactggaaaaggcccgcgagctggaagggaggggacgggtgcaccctcagagttattgctggaggctgtggccagaccgggcaaggtggtgactcccgctggcaggctgaggcccaccccagccctcccacctgggccacggggctctcagcgggagccccagttatgaccggacaccagcgcaccgccaaggagacagccacgtggggacatgctggactaggagggtcagagccagtttgagggtctggtgacctcggctccctggcttaaccaggtccttatgggtgagaatcctgaggagggggagagggatggaggctagggacaggaggcaggaggagctgatgaataggaaggagggaagaagatgaaagaaacaaaagggaagtaattacactcagagcactgctctccttttccatgtcttctgcgccttcacagtcttcaaaggtgtccatggagctaaactccctgctggagcagccttagggagagaaagggaaggatggggcctctgtggggtgggaggacatcccctctgcccatggcagggtgtagcaggcagtgcctgttgcaggcacggtcctccccatctctaactcctgctctccaagggcctgcactgcgctgggctgtgagggggtctgtgatctccaggctgcttttccagcgccgagatgccgtaattcaccgagaaggcgcgtccacatgctgttcatggccctacctccccgttcctccaagaaaacagtcattgttttttgtgtttgccagtcttctaaccacgcctccttcccttcctcctcccctgtctctttctcaccctcccctccttgcctccttttctctcccctaattaatgtccatttcccatctccctggcagcctctgccaagtgtcactgctccccataagggaaaatcagaggaacaagcaagtgcatccatcctgcctctctctgcagtgaactgattaattaatccatcagtcttgtctatggcgcacatgttacatccctggggcggtgttggacactgtggggaacagcagccactgccaaatactgaacaactgccctgtgcctggtggtatgttaggcatttgtcaaagtttaagcctcacaaccctgtaagggtctcagccccctttacagttggggaaacagacagcaatggtcacttggccaagtcctcttggcctgtggcagggcagctgtcttctccagcactcctgctctttaccctcgctctgagtgagatggagtctctgccccacatggctcacaagccagggtagggagcagagcatctgcagaaaggtcccaacacaggacagccccagaccgagggtcagctgagtagtctacgcggcgggagccgtgctaggaaagtgtctgctcaggcgagaattcagggaggtttgggcaggacttgaggggcagacaggactggagagggagggcattctgggcagaggcatggccagagggcggtaggcggcagtggagggagctgcagttatctgggtgagcaggcagcacaagtrgcgtctcctgggctgctgccccaagcccccaacaagccacgttctgggccccaggccctccccagagcagatcagtgggggctgtgtgagtaacatgggggcgggggggcagctgggcagcacctccctggaggcccctctgaaatcctgcctgactctggcaggctccgagggggctggacaccctcctctcaggttgaagcaagtcctggttgagttcctagtcccaggaggtgggaggggcaaggggtggagggcagaggagaaactgcctcagggatgtgccccctgccttcatcctccagacaggacttgggagcatctaaggaaacccaagactcctctttagagaagtcatccagccctggggtccccttatgccaggagcaagcagtgagaatggaagaatgattgtcttgctgaaagttctgtgatggagggatagagggacagagggagccatgcccttgaccatcccctgcatgaataggaagggctgtgtctccagggtccatggcctctgtgccccggatgatgccagggctgctagggaccatagagccacccactgggaggctggcggttgggcctggctcaggagccttcgtcagccataggcagccacagcctggggtgggcagggctgggaggcgacacaggaactgaaaaacctgacaagctctagcccctccgcagggtaagtggtacctccaggtaaaatgattagttkgttccagcccctctgcagggtaagtggcacctggggtaaaatgactgcctggagctggcagctgctttccctgctctcgcgggccctgcagggaagcggggaagggaagggggcacagcgctgggcacagaggggctctcagaccctggactcaactgtttcagggtcatctgaaacagtcaactgtttcctctagcccattccctgcctccaggcgaggatttgcctgaacgtggaaagaggaaggatcctcccagtgctgtcaaccccagattccacctccctgtgggggactgtcagcgcaggccctgacaacgcagagaaagacacaggacccacctgggccagtgacagcaggagctccgggtgccacaggtgagggtggggatgcctggagcaccacggggggcctggtttagtctagagccaggttttccatacaccttagagtgcaacctcagggagatgcaaattttaccccctaacacagcatacacgcagaaacacatttatacaattcaaacacaagcggacggaacaatatttacccttagagtgtgtgaagtcctcatctgtcccacctcatcctatcatgctttgttctatcctaggagacaaagcaggagggggggctgcggaggtgggggagtctcatccaagcccttgggtgacacgtctctcctgagacaaactgcagctgctctgggtgtgccctcgcctgtctccctccaggccccgggttcctgccagcagagacagtaacctattcaccaggtatcccccagggctcctggaagaaactcagaattctcagaaccagaaaaccttagagagcatcctgcaggcaaagcccctggttctctgcggaggaaagtgcggctcacagggtgccccgccagggatggtaattgaccaccaggctgtgtgccttgtggggactggcttaaggccctgtgggagctgagtcagggccaggaccggggtgtcctgactcctagagatcatgttcccttcctcacccaggccttccagtcccagccctgggcttttatttatttattttggagacagagtctggcttgtcacccaggttggagtgcagttgtgtgatcacggctcactgcagccttgacttcctgggttgaactgatcctcccacatcagcctcctgagtagctgggaccacaggcacatgccaccacacccagctaatttttgtattttttggtagagatggggttttaccatgttggccaggctggtcttgaactcctgagctcaactgatctgcccacctcagcctcccacagtgctgggattacagatgtgagccatcatgcccacctcctgggctgacttttgctgtcttacatcatctgcatatttaatcccctgctggattcactggtcatgggctctgaggccctaagagtcttaggcactaaggagctggcagcactgaggggaccccaaaatctcagactcaggatctggccagtcacaggcatgtgagggaacaactgagaggcccattgccccatggcaggagaaggtgctctggagtcagtcagacctgagggcagtcagacctgattctcactctgtcactcactagctgtgtgatcttggatacatcacttaacctcttgagcatcagcttccttatctctaaaatggagataataacatcgattttgcagtcttggtatgaggattagcaaatcttctgataaagaaaaatgcctggtacatcataggaattcaacaaatagtacctgttatgattattgtgtatagcaattacaataatactaaagagagggtctcaaaacagctctgggcactccaggtgtgctattattacttacatttcagggaggtttgtctgccattgtctcatcctcataaacactcagggaaagaaacattataaggataataaatggctttaaaaagaaacagagcaaacacacacacacacacacccctcagaaaaaccatgccaaacacacaggctcttgacaaatattcaatctgattatagcaaaactgttttgttttgttttgtttttttgtttgtttttgagacaggggtctcgctctgtcgcccaggctggagtgcagtggcgtgatcttggctcacagcaacctccttctcccgggttcaagcaattctcctgtctcagcctccagagtagctgggactacaggcacatgccactatgcctggctaatttttgtatttttagtagagacagggtttcaccatattggtcaggctggtctcgaactcttgatctcaggtgatccacctgccttggcctcccaaagtgtgagattacaggcgtgagccaccatgcccagctgattatagcaaaattctaagtgatagttgtattcttggaaaatgaatggaacgacttttgtcccagccaagatctagtggtgtgttggagcagatacaccctgagtctctggggcactctcagtctatgtatcagataagcataaggagtattggtggagaaggacaagaatgggaaaggtgggcgatgagaattcctgcagataaggactggtgagagtattctcttttgaaacccttagtcgacaatctttctggtgcatatcagataagctgaatggtttaggaaatctagtgttcacatttagtgcttagaattctaagcttttttattttgcttaaacaaatggaatgaaatttattaacaagtgaacctagtaatgagctgaaattattctcaccagcatacatatttttggtaaattatagactttgaagacaaaatcatggtgtttcccttactgtccagtggatggcacaaagagaccattgtagatcctgctggttcagcggtagctctcaatccatagatattaaatgggcaaattctatttttattgtctttcaaactagatttttctcaatgcacaactttttttttctttttcttttttttttttgagacggagtctcgctctattgccaggctggagtgcagtgacacgatctcggctcactgcaacctccgcctcccgggttcaagtgattctcctgcctcagcctcctgagtagctggggactacaggcgcatgccaccatgcccagctaatttttttgtaatatcagtagagacagggtttcaccatgttggccaggatggtctcgatctcctgaccacgtgatccgcccaccttggccttccaaagtgctgggattacaggcgtaagccaccgcgcttggccaattatgcacaactttttaaggaccatctctatcacatgaactaaaggatatcattttcacttgggggtgggaagtggtgagctgcttaaaagcaatgcctaaaccccctgggctttccttcctttcacttggaagaaccagggggtaactaactgctaacaattccatgctttcagagatctaggcgcaagcctaagggcttcatctcatttaatcctcatggcaagactgtacagtattatctccattttgtaaaatgaatgataaaaagaacttaagcacagacaggctatagaatccatccaaagagatggagctgcacttgaggctgggtctttgagacctgagtttgagcccttcatcattgtgttgtgtgtgctgctaaccaatttcccctctctgtcttctaggatttaatacatggtgtcacattctgtctgatccatcccagtagctctccagagctcccaacaggagagagttccaaaatgtttccaggggtactaggctcggttacaatattttgcttggtggcccagagtataaacgtggatatcttaggctggtctatagctgaaacgtctatttcatttgcaagcctatctttggctaagaggaagtgaatcattcttgagaacatctaattaattgctttcagattccacatgttgacattctcagggcacattttttttttcccgtgcatttctgttgtcaaagtccctgccagctcctaaggcagtctgagctggctgtcttagactttcagagctgctggaagcttgggggagggaggggctgtaggtcaaagaaactttataacctagctttacctcccagctcagccaccagctgccctcaaatgttctggattggaataagcccaaagatgagtggcaggagggaagggcaagccaatacgtctagtttggttcagtcaaagccttgcccatttcatcagaattttaatggaaaatttccaataagattaaaatataaggtcaccccaattttagtatggctccatttaaaaaaaatcatgcatatctttgttttgcaatggggccttactcttgcccaggagaggtgcggtggtacaatcatggcttacggcagcctcaacctcctgagctcaagcaatcctttcaccttggcctgccaaatagctaggattacagacacccaccaccatgcccagctaatttttaaaaaaaattttttgtaggtccagtgcagtggctcatgcctgtaaatctcagcactttgggaggccgaggcaagcggatcacctgaggtcaggagtttgagaccagcctggccacaatggtgaaactgccgtctctactaaaaacacaaaaattagcgaggtgtggtggtgggcacctgtaatcccagctactcgggagactgaagcaggagaatcaattgaacctgggaggtggaggttgcagtgagccaagttcgtgccattgcactccagcctgggcaacaagagtgaaactccgtctcaaaagtttttgtggagatggggtcttgcgatattgcccaggctggtctcaagctcctggatatcaagtgatcctcctgctttggcttcccaaagtgttgggattacaggcatgagccaccacaactgaccaaatcatgcatttctatagacaacgtctgcaagaagatattaatggtgattatatctggttatgttggatttgtatttttatttgtactttcctgtattttctaaattcctgacattctacatgtgtactcctttaataatcagaaaaggaaacttaaaatagttaaaaccaattggtcagatatgtaaaataacccaccatctctccagagagggctgtttgctagaacttattttcttcattgaaatactagagtgccccaataagtttgaataacacaaaaaaaaagataatgaaagtaactaaattatctaggcccaaaaggaaatgccacaaaaattggcaaagaaacaaccatgacgtgctataccggatagctcctaggcccccttggagaccctgaggtacccgacgagggacctgtagtaaggctggcagacaggttcttcctctgttagctctgaggtacaacagttattctcatttttatgtctttcacatggccagaactttgcaaatcagaggcaaagtgaattcagaattaaaaattttcagcaccatccaagtcagtaaaacagtcttagcttataacctttattttttttattattttattatttttttatttttggatggagtcttgctctgtttccaggctggagtgcagtggcatcatctcrgctcactgcaacctccgcttcctgagtccaagtgattctcctgcctcagcctcccgagtagctgggacgacaggcatgcgccaccacgcccagccaatttttgtatttttagtagagacggggtttcaccatgttggccaagatggtctcaatctcttgacctcctgatcctcccgcctcggcctcccaaagtgctgggattacaggcgtgagccaccgcgcccagccctttatttttactgtaagctgccagtaaacagcacacccacctgtctgctgactgtcccatctggaagttgtgtaggtccttactgaatcttaccttcttcccttcccctacccagaccccatcccagctggcacgtggaatcctttccctttctcctcatgtcaatagaccagcaggcaaagagagcagttaccatagtggaaggagaaacgggtcctagtcgtggtgaggaggtagggctgctgcttaacaraggccgagagggacatgtctgatgctcaggtgatccactaggacatctcgcaatactcccatgcccagctgtaactatgatggccaagtccaagaaccatagcctgataagagtctaggacccccactatacatgccaccagtagaagtgcctgatggggagagggatgtctagaatgagtaggagggaatgatgacaaagcacagccaaggaccaactgcagtggcaggtggcagccacagattgagttaagtaggattcttgctgtgttccctagtggaagcatctcccttgttgagacccactgaggttaaagttggagacatggggagaaaacaatgtccccgtgttcatcactagagtcatgatgggcaaggtcacaactcatttgacttcttggctcccagattcatatactctgcctcttgggggcacttcaccataatacagccattggttcagttgtatgctgcatcctgagggacagcactccatccccgcagtgccatgtccaaactgctgccccgcctcactctcaagaggctgtcccactactctgtcaggcaccagcttctgaatgcagtggtaagactctgtcctgtgatcacgtctatggctgattctcttttgccatactgagtcccctgatcaaagcagtgttatacagcctggcgcgctggctcatgcctgtgatcccagcactctgggaggcagagggggatggatcactagaggtcaggagttcaagaccagcctggtcaacatggtgaaaccctgtctcctctactaaaaattcaaaaattagctgggtgtggcatgagcctgtaatcccagctactcggaaggctgaggcaggagaatcacttgcacccaggaggtggaggttgcagtgatccctgatggtgccgttgcactccagcctgagcgacaagtgtgaaactctatcgcaaaaaaaaaaagcaacgcttatgattgatcacacactgtactttctaacctgaaggggtctggtaaaatcaacttgtcttctcaagggacagtaccaaactgggggctcagcactgacctctgctggcatgtcggacatttaaaagtggtagcagctagagcagtcttgaagacatggagccctcactgctggggccgagcactgctgggttcaattctgctaccaaggcttctccatttccgagcccatggtgcaggcactggggtgcctaagaggaagtgcactaactggacttctgctatgcaccttctttagggggcattaaagcacagttcaaagactctcacattttgagttaacccccacaggcctgtgtgccccttctccagtcaggtcatgttgtcatttgatcctagttattattctgaaagggttcaggaagggaggtggggacagatcttgraaagggcaaacattgccttgtatgcctcatctgaggcttccgcatagtcttaggggactgggaaccgtcttaagtgaatctcaccttcttcccttcccccagccaggccctagccctactggcatgaggaatcctatctctttgtcctcatgccaggagaccagcaggcaaagagagcagttaccatactggaaggagaaatgggtcctggtcatcagaaggaggtactcctcaagggacagtacctgagggagacacttccactagggaacacagcaagaatcctacttaactaaatctacggctgccgcctgctgctacagttggtccttggctgtactttgtagtacaaggcgaagtaggccactgctgccagcccaggaggtcaagggcatttacccagacatcctcattcccagtttttgggtcccttatcttccctctcaggatctaatgactcatctactggcactaggagtccaaaatgaccagatggcagactcgcctaggctgagaattcttccttctctcaaattctgccacttttaccagcccagtctgcctctgctgtaggagatgagaggctaaatgttggcagggaggccccctgattctgatcctgtgttttaaatcgataattagtcygaccctgttactttctcccttcagtgcatcaacgggaggctcttagcaacagcctcccaactctaccttcctgatagataatattttcctcaaagctctcaaatgctagagacattgcaccagctggygtgtccccatccacctgtatctgatcccaggtcaccacaggtgaaggtctgagcaatygaactgctacagcaggccaggtaccaggactctcarcacgccacttaacaccaataatgaggtcctcatggccatttggcctgcagtgagccaacaccagaatcccatccattctgggacccctcctgctactaacggtcttcagtcaggttccccagaagcagattatgcaaatgtgttattgaaaaacggctttcagatgaaacctggaagacagtgaaggccgaagctagggcagggaagaagccaggcacagacgtgggcttagcagaagtctagcatcagcctgatcccctgggcagtactggagcatggatggcaccacaggttaccatcttgagacagaaggactggcttctgtaccctgaatcagtaagccattggtgggccataagccacccttaggggaggacataacctcacaggcatttcctggctggacgaccctgggcagctgagggcaactgcctgaagggcacaacggtgagccattgtcagctaacctcacagcagcagagacatggggccaacagcctataaagagggtctgggcaggctgtcaatactctctactgtaatactgtatatgtggtttattttaaaaacttttttagaaggctttattttattttattttttgagaaggagtttcgcccttgttgcccaggctggagtgcaatggcgcgatcttgactcaccacaatctctgcctcctgggttcaaggaattctcctgcctcagcctcccgagtagctgggattacaggcgtgtaccaccatgcccggctaattttttgtatttttagtttcatcatgttggcctggctagtcttcaactcctgacctcaggtgatccgcccacctcggcctcccaaagtgctgggattacaggcgtgagccaccgcacccggctgactttatttttttagagcagttttaggttcacagaaaaactgagaggaaggtacaaagatttcccatatatcccctgtgctcacacatgcatggcctccctatcaccatcccccaccagagaggcacatttgttacaatggatgaacgtatacactgaatatatcatattcacccaaagtctgtagctcacatcatggttcactttggctgttgtacattccttggatctagacacttttataatgacaggtacagtagtccccctttatcctcaggggctacttccaagatccccagtggatgcccgaaaccgcagagagtgccaaacttgactgccatcagtgggaatatgtttctattcgccttccaccaccaccggtttaacgcctttttcatcttagtgctgctgccgtaactttggcagtttgagatgcgacagcaaaatgagtacaaatttctttctccttcttcacaatgtcatggacagatgattccttcttaccatagatcttagcaacctcggtgtgtgattttttttctttcttgttaaatcaactttcaccttttcacttaaaggaagcatttgacggcttctctttggcatatctgaatttccagcatcacgactgtgctttggggccattgtttgtttatttatttatttattttatttatttttttgagacagagtctcgctctgttgcccaggctggagtgcagtggcgtgatctcggctcactgcaagctccgcctcccaggttgacgccattctcctgcctcagcctcccgagtagctgggactacaggcgcccaccaccaagcgcagctaatttttttttttttttgtatttttagtagagatggggtttcactgtgttagccagggtgatctcgatctcctgacctcgtgatcctcccgcctcagcctcccaaagtgccgggattacaggcatgagtattttatttatttatttattttttcagacagagtctcactctgtcggccaggctggagtgcagtggcaccatctcgctcactgcaacctccgcctcccaggttcaagcaattctctgcctcaaactccggagtagctagaattacaggtgcacaccaccacgcccggctratttttgtatttttagtagagacaaggtttcaccatcttggccaggctggtcttaaactcctgacctcaggtgatccacccacctcggcctcccaaagtgctgggattataggcgtgagccaccgtgcttggccttggggccattattaagtaaaataagagtcacttgaacacaaacactgtgatcctaacagtcgatttaatcaccaagatggctataagtgactaaggctggcggggtggggagcacagacagcagggacaccctggacaaggggataattcgtgtaccaagcaagacacagcggaaggcgccagatttcatcgcactactcagaatggcatatcatttaaaactcatcgattgtttatttctgtaatttttccatttgatatttggacagcagttgactaagagtaactaaaacctggaaagtgaaacagtggataagggggtgctcctgtacttctcaatgtgagacatttgcccttcatgttaattctgccccattagytctacacaaatgaatagcaggaaattgattttaaaccacatggtggtaaaatgctttcttttttctccctcatttaactaaagaagggctgggccctaggtgatgtcttccttagcatctaagcagctggcatcaccccactgcttctgtgctccactctcccatgggaccctccctacctttaatccctcctgtgctggaggccgggtcttccttgctagtggtagctctttccatatttttaatccatggtccggatcctgctccactgcctttgctttagagaaataaacatgaatattgagtcactggaaggaatgacacacgcatccctcccccaccagttggagtaacgctggcccacctagtgtatctctggtctaggtctcgaggacctgctgctcctccctcacctgtagttgaagacctgcctcaggtcagtaggtgatacgcagtaaggaaatgtccaaaggacacttcttgttggattacacagcaaacatctaattggctgcaaatctttttttctttttctttctttttttttttgagacagagtctcgctctgttgcccaggctggagtgcagtggcgcaatcttggctcactgcaagctctgccacctgggttgacgccattctcctgcctcagcctcccaagtagctgggactacatgcgtgtgccaccacacccagctaatttttgtatttttagtagagacgaggtttcaccatgttggccaggatggtcttgatctcttgaccttgtgatccgcccgccttggcctcccaaagtgctgggattacatggctacaaatcttaaagggggaagagatgaggaggaataatcccctttgtcttctcaaaaatgttttcactggctcactacagctccctccttcctctttactgacccaaaatgccaactattatagtaactcttttgggttagacgaatccagtgaataaacacctactaagcattggaggtccaagaggaataagatatgcctgagctaaacctcatcacccccggccttgcttgcagagtggtttgctggcctcatctgattattcaatgagtgctttcatttgtttattcactaaatatttactgagcacctacaaaagtgcctggccctggtagatgaggcctgagggaagctaaaactaataagacaaactccatgccctagaggaattcatggtctcatagggagaaaatgtaaacacatcataaaattatagcttattaaatgctgcaatagagtactccgtaagagtgtgggggcagagaggagggggagaaacagctgctttctagagccctcaccttttccacttctctcatctttctgggttagggtctagcgggggttccatgaggatcaggctaaatgagcttagaaaaactaagcagactactgtatcagaactggatcacagtagacaggcgttttcaacaaacatatattgagtatccctgagtgctttggacaggaagaggaattatagacgaagattgtaagtcgcagtaatagatgaggcaaggagcaccagtgaggacttaaccctgaaagaagtgtgagcacatcttcctcccagacaagggggaataaagaaaggaagatgatcaggagagttctaagtggaactcagcagccagaggggaagcyggaggaggtaacatcagagggtgcgtttgcccactcagtaaagtaggaggcagggcagccttgtgaaaataggaatggaatagaaagctcaagaaaacagccaaaagcaagggcaattaggggaggtttcgaactggcagatctacctcaactggcaatacagcaagcatgcaccagaaaagatatcctagctagcagtggggttgggaactgatttaatatcctaggctagcagtggggttgsgaactgatttattatttaattttttatatctattcatgtatttatgcacttatttatttttgagataggctctcgctctgtcacagaggctagagtgcagtgatgtgatctaggctcactgcagctttgacctcctgggctcaagtgatcctcccacctcagcctcctgagtagctgggactacaagcacgccaccacctaggctaatttttgtatttttttttgttagagacagggtttcaccatgttgcccaggctggtctcaaactcctgggctcaagcgatccatctgccttggcctcccaaagtgctgagattacaggcgtgagccactgcgcccagccaatattttttaaaaattggaaatcccttgtaataagccaagtgttgggggaagaaaagcaataaaagcaatgacatggactcaatatgaaacatccaaagcatttgacatgcctttaaaataaaaaaatcagtactcacctcgtgctcatttcaaactgtggatttccttggtctaaaattttaaaaaacaaaaaacagcactctcaaatttaagctaatttgaattgattttacatagtgatttttaaatacacatatatgcataaagagaatactataaaaatatataaaggtgtgtaggtcttgatcatattttcccaggaattcagaaaacgctgctacagtccctgggctcacgtggtcctggcatcctccccaacgtctctaccccatcctgctgagtttctggcatgcattggttctgggtctgtccaagtttctactgttagctccattaatactgaattaaggaataaacagtgctcaaatgctcattttttccatgtgagcccaaattatgtgacttgatgagggaaaaaatcatgagtccctgggagagcgataagaatcacattctttactaaagtgttgtcccaggtatgagaataacaccagatctcaacctccagaggccccccactgcctcccacagcataaaagccaaattcctcggcccgatatttgaggccatctcaatctttttcctttcaccctatacctgactctcccaggctaggctcagatcgtcactgaatgtgctcacttcgaggcacctctgtgattttcaaggttcctgggcccaccttttactaccgatgtgactgccacatgttgcccagttgctaggatgggaccgtggccttgatttctgccgggactgaggctttgccttgtttcccacccaccctgctgcctgcccctgcactcttctggctggggcctgatctttccccgcagtctcccttcacctctagatcacaggcagtcatgccacagctgaggagcttgtcccaaacctcagtgcctgcctccctcctcggcttcttgtgctgctgtgtctcacccatcagtgaygctcttctcttccctgcccaagccctagctgactccataacacctggatacaatgtcctcttctgtctggttacctccgagaggccctctctctacatccctcattggctcccagtgtcattcctctcacccatggccctaaggtcactgtattctttggccagtgtacagggttattatgcttaacaatccacaaaggttgaaaggtgttgtaggatggtgtaaaaatgaatctgggtggtaatgtttatatgtcagagctttgtaaagtgctcggcaggcgtaaggtactgacagtcctgatattcctgatcttggaacctgggacaccatcttctcaacattgcccggataccctcaagggtatccagacagcctgagtttgcattctgttcctggttcagcccagggccctggttcccgctcactcaccatccactgtgggccctctctaaattcttaaagcccttgccatttgcatcactcacagagacatttcatcagagcctacttggtgcaccaggctcaggagactcagttctgctgcggataagttatgtaaaattgaccctctgcttgcacatctgtaaaaggaaggggctggcacaacacctctgggcctttcagttcagtagtgttttctttttatctaaaccacgtgctgggtcctggttttgcttcttatctagatttttgcattcctgtcacaacctataaagcacagttcaggccttaaggagggcttgagaaatctctttccgaattgtcaactgaataagtgtcatatcttcataacaaacttgtctttttttgcagggccaggaaggcagcaggggagtcagttaaaatataaattttagattaagcttaatattgttaagaagtcaattctcaccaaattgttctagagattttacataatcctaatcaaaatctcaataaggttttttgagaagttggcaagcagattctaaaatatatatagaagtataaaggacacagaataatcaaaacaactttaaaaaggaagaacaaaattataggactctaactacctcattttaagacttattagaaagcagcagtaaccaagatagtgagggactgatgtcaaggtagacaaatagatcaatggaaaagaatcaggcatccagaaatagatgcacttacataaatcatcaattggagaaagaatagtgtttttaacaactggcaatggaaaaactagaacatcagtatgcaaaggactgaactttgatccatacctcacaccacatacaaatcaaaaacagaaacaaacaaacaaacaaacaaatactcaaaatggatcagagacctaaatgtaaaactataaaacttctggaagaaaacacagggagaaaatctttatggcttttagataacgatttcttaggcaggataccgaaaacatgatacatacagtttttaaaattaaatattataagaattaaagtcttttgctcttcaaaagtcactcttaagagaaaaagatgccacacactagaagaaaatatttacaaagcattaaaaggacatatatctaggatatacataaaaactctcaaaagtcaataataagaaaacaatgagcaaaagatttgaacagacacttcaccaaagaagagataaagatggcaaagaagcacataaagagatgctcaaccattagttactagggaaaagcaaattaaaacctaatgacataccactatgcccctattagaaatctgaaaatttaaaagactgacaataccaagtattggtgaggacatggcacaagtggaactctcatacattactatgggaatggaagatactataatcactttggaaactatttagaaatttcctaaaaaattaaacatacacctaccatatggcctaaccattacactcttaggtatttacccaagagaaatgaaaacacatgtccacacaaagacttgtacttgcatgttcatagcagcattattcaaaatagccccaaagcagaaacaaatcggatgttcattaacaagtaaatggataaagaaaacggggtctagccaaacaatgaaatactactcagcaacaaccaaaatatgtactattgtttacaaaatccaaatagatgaatctcagaataattatgcagaggagagaagccagaccaaaaaaaaaagtacatagtgtattatctcttatgaaattctagaaaatgcaaactaacctatagtgacagaaaggagattggtggtcacctggggtgggtgagggaggggcaggagaaagggaatgcaaagcagtgtgaacaaacctttggcggtgataggcatgttcattatccttactgtggtgatgccttacagatgtatacagatgtcaaaacttatcagattgtacactttaaatatgtgtggtttatcgtgtcattatacctcagtaaaggagttttaaaaattgtagtaaaaggtctctacctagaaaccttaataagctaaaatgtatgtccccaggactaaccctagctattctatagttctggggtggaacctagaaatctgcatttgtagcaagcccttcaaataatttgaatgcaggtggtccttaaaccaccctttgagaaacactgacctagtgagtaaggatttctaaacaagcttgtgactagaatgttgtttctgcagggaacaagtgactttttctactagagttgccatatcattctgtgttaagcctctaggacactcctactcaattaccatgacatatatttaacataatattaatagttgtaaaacaaaagtaaaccatagtttttttcccatcttatctgtatacaaagtaaaatcaatgacataatattgttactagttcctggcagttacctacagtttaaatcaagaacttatgttgcttggtttttgtgacagaaaactgatgtggtggctttccagttacactgcttggtttaccttttcccttatcttatgatgcacacccagctttgcacgttcctgagcagctgatgatcatagaagacctagaaaaagtgtgagccagttgcattcctgctatctctaaagaaaaaagttatcttttcatttttatgtgatttttcttacccaaaatgcaaaccactgccagtataaatgatggaagatagactttccacatgaaactggcatttcttcaccctagtaacattacctgaggggaaggtcagaactcaattgataaagctcgctgtggattttcccaccaaatatccctgcaaacaaagtgaaaggataaagcctgcttaaagatgatttgtaattgttgaaaggagtacagtgtgtgacatcagtgaaaatggtggagaaaaaacccgtccccaaattctcttctttgtgaaagcatggaaaaaactggccaaaaatggttagaaaatttattttcagaatatcgaaatttttttttccttttttttttttttattatactttaagttctagggtacgtgtgcacaacatgcaggtttgttacatatgtatacatgtgccatgttggtgtgctgcacccattaactcatcatttgcattatgtatatcccctaatgctatctatcccttccccctccccccaccccaccacaggccctggtgtgtgatgttccctaccctgtgaccaagtgttctcattgttcagttcccacctatgagtgagaacacacggtgtttggttttctgtccttgcgatagtttgctcagaatgatggtttccagcttcaccatgtccctacaaaggacatgaactcattgttttttatggctgcatagtattccatggtgtatatgtgccacattttcttaatccagtctatcattgatggacatttgggttggttccaagtctttgctattgtgaatagtgctgcaataaacatacgtgtgcatgtatctttatagcagcatgatttataatcctttgggtatatacccagtaatgggatggctgggtcaaacgatatttgtagttctagatctttgaggaatcgccacactgtcttccacaatggttgaactaatttacagtcccaccaacagtgtaaaagtgttcctatttctccacatcctctccagcacctgttgtttcctgactttttaaagattgcctttctaactggtgtgagatgttatctcattgtggttttgatttgcatttctctgatggccagtgatgatgagcattttttcatgtgtctgttggctgcataaatgtcttcttttgagaagtgaccgttcatatcttttgcccactttttgatggggttgatttttttcttgtaaatttgtttaagttctttgtagattctggatattagccctttgtcagatgggtagattgtaaacattttctcccattctgtaagttgcctgttcactctgatggtagtttcttttgctgcgcagaaactctttagtttaattagatcccacttgtcaattttggcttttgttgccattgcttttggtgttttagtcatgaagtccttgcccatgcctatggcctgaatggtattgcctaggttttcttctagggtttttatggttttaggtctaacatttaagtctttaatccatcttgaattcatttttgtataaggtgtaaggaagggatccagtttcagctttctacatatggctagccagttttcccagcactatttattaaatagggaatcctttccctatttcttgtttttgtcaggtttgtcaaagatcagatggttgtagatgtatgatattatttctgagggctctgttctgttccattggtctatatctctgtttttggtaccagtaccatgctgttttgattactgtagccttgtagtatagtttgaagtcaggtagcgtgatgcctccagctttgttcttttggcttaggattatcttgacaatgcaagctcttttttggttccatatgaactttaaagtagtttttttccaattctgtgaagaaagtcattggtagcttgatggggatggcattgaatctataaattaccttgggcagtatggccattttcacgatattgattcttcctatccatgagcatggaatgttcttccattggtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtaatttttgcacattgattttgtatactgagactttgctgaagttgcttatcagcttaaggagattttgggctgagacgatggggttttctaaatatacaatcatgtcatctgcaatttgacaatttgactttctcttttcctaattcaataccctttatttctttctcctgcctgattgccctggccagaacttccaacactatgttgagtaggagtggtgagagagggcatccctgtcttctgccaggtttcaaagggaatacttccagtttttgcccattcagtatgatattggctgtgggtttgtcataaatagttctcattattttgagatacgtcccatcaatacctagtttattgagagtttttagcatgaagggctgttgaattttgttgaagacctttactgcatctattgagataatcatgtggtttttgtcttcggagaacactggaaattaaatgatggcttgcagcaatctggagagcatttattcaaggaaaatggctgtgtctcagtatgactaatgagctttttaacttgccctatttctatcctccccttccttggtggtagccttagaaatgaacagcctgcaatgatagtgaaaatcagcagtctggcagccatgggaggggcagaacaggaatgggggaactatggagcctcattcttagagaattatcattatttgatctgtccacgggtttctaggaatacctgacctgcaagtctgtctttattaggcctgactcagaacttgcccaatgtgaaaagtcttttccccaaaggcctttgtagaaaatgattacaggcaattgtttaacttcttggttgctcgaggtattggctaacagtggggcaaacatgggctaatcagaaggtttaaaatgaaatgctcaggaataagatgctcatagagggttgtaaaggctccaaaatatttatgagactctagaagaccatgcacacatttcctgtgaacatgttcaggacagatctgcgaaggccccacgatcttacctctggctgatcttgatgatctgcacaaacagaaagtgaaagctaggctagaactgtcaagtgccaggctgagtgtgaaggtgtgccctaatgtgcacacagagccccttggcaaagactagaagacttactgctttcaggtgtttaaagaaatctctgtcatgtcattagtatttagatcactaagctaactgaacagaggcttcaatggctgcacataaatacagacttcacagaattagtttagaaaagtcactataacaaacaacaataaacagcaacaccaacaaacagtagaggtgggaaggtccaatttccagagttgctacattatgttatttaaaatgtgcaattttaacagaaaataatgagacatgtaaagaaataagaaaatgcagtccatacccagggaaaaagaaaaaccagtcaatacaaactgttcctaggccaggtgcagtggctcatgcctgtaatcccagcactttgggaggccaaggcaggcagatcaccagaggtcaggagtttgagaccagcctgaccaacatgttgaaaccccatctctactaaaagaaaaatacaaatttagccaggcatggtggcgtgcacctgtaatcccagctactcgggaggctgaggcagaagaattgcttgaacccaggaggcggaggttgcagtgagctgagatcatgccattgcactccagcctgggctacagagcaagactctgtctcaaaaaagaaaaaaaaagaaaaaagaaaaaactgttcctgaggaagccaagatactgactttactagaccaatactttaactatttttacatgttcaaaaagttaaaggaaatcatatataaagactaaaggaaagcacaagaacaaatcctcattaaatagaaaatataaagatttgttttaaaggacgaaacagaaattctagatttcaaaagtataataattgaatgagaaattcactagagtggctggctcaatagcagatctgagcaggcagaagaaagaattagagaactcagaaataggtcaattgaatctatccagtctgaggaagagaaagaaagaggaatgaaggaaaaatgaatagagcctcagagactgtgagataccttcaagcacgctaatgacgcataatggcagtctcagaaggagagagggataaatgggctaaaataatatttaaagaagcaatggctgaacatttcccaaatctgatgaaaacattaatctataccttcaagaaagtctataaactccaagaaatataaattcaaagagatcaagatccacacctagagataacataatcaaactgtcaacaaagacaatgaaattatcttgaaagcagcaagcacatagaaggactcttcaataagattaacagctgatttctatcagaaatcacagagttgagaaggcaatgggatgacatattcaaagtgcttaaagaaaaagagggtcaacaaggaattctatacctaaagccaatttatcttcaacaaagatgccaagaccattcaaagtggggaaagaatagtcttttcaatcaatggttctaggacaatggatatccacatgtaaaaaaaggaacttgggcccctaattcacatcatatacaaaaattaactcggaatgagtcaaaggcttaactgtaagagttaaaactataaactctttgcaaagaacactatcaagagagtaaaaagacaatgcacagtatgggaaaaaatacttgcaaataatatatctgataaaagtccagtatccagaatatataaataactcttacaattcaaccataaaatgacaagccaattaaaaaacatacaaatgagttaactgacatttctacaaagaagatataccaatggccaatatgcatgttaaaagatgctcaacatcactagccatgagggaaatgtaaatcaaaatcacaatgagatactagtacatgcccactaggatggcaatgataataataataataataataatgttattataatgaacaatacaagtgttagtaaggaaatggagaaaattgaacccaactattatattgctggtgtgaatgtgaaatggtggtactgttttgaaagatgatttggaagttcctcagaaagttaacaaaagttaccatatggtctggcaattctacatatatacaccaaagaaaactggaaataaagattcatacaaaaatctgtacaaaaatatctacagcagctttacttacagtatccaaaaaggggaaaaamcccaaatcttcatcaactaatgaatggataaacaaagatggtatatccatacaatggactgttactcagccataaaaaggtatgaagtactgatagatactacaacataaatgaaacttaaaaaaatacgcaaagtgaaagaagctagacagaaagggccatatatgtgatgtgtagagaaaacatccaatagagacaggaaatacattagtgattgccaggggctgggtaaaggtgagagatggagaatgattgctaattggtacagaatttttttgttgggagagttatgaaaatattttggaagtataattagaattaggctgttaaatactttaaaacaaaaaacagctgggcgcagtggctcacacctgtaatcccagcactttgggaggccgaggcaggcagatcataaggtcaggagatcaagaccatcctgcccaacatggtgacaccctgtctctactacaaacacacaaattagccaggcgtgttggcgcgcctgtagtcccagctattcgggaggctgaggcaggagaatcacttgaacctgggaggcagaggttgcagtgagcccagatggtgccactgcactccagcctgggcgacaagagcaaaaactccatctcaaaacaaaacaaaacaaaaaacaaaagtaagaagtaaaaaaatagaattagactggggatggttattgagccttgtgaataatctaaaacccactgaattgtatattttagacagtgaatttgatggcatgttaattatatcttgatgttttaaaaaaagtagtacagtgtctgaaaggtagcattggccatttgaatctctgttaacattttcttgggtggccatcagatttttgattaaaggtgaccttggcaattaagtggtggggggaacacaaccaaaagggacaaaccaacacaaccacacacaatcacacaacccctccacctccaccacagtggaaatcaagcataggtgcttccagggactgtgaaaatgtggccacagttgttttcccagcaaaccattttctttcacaatatccccaatttgcacatcccccactgagctgaaatcagtataactcgacagacgaaagtcagcaggggtaacctacctttgatattattttgttgttccatcaataatttacttatttctgaaaaccaacagtctctgatttcttttgaagctgcctgcaatcacacataagaaaacactataagactaccatgagtattaattgcagagtttttattctcccagtgaccgttagactaatgagatagaaaacacttgtcaagtcatgggaacacaataaggaaagagtagaggagacccatggggaaggcatgagcgttacctgcaggatgtatttctcaagtccatttcgactggcaatctcaaactttctatggctcccccttccaagctggcgaattgaaagtgtcatcagctattataaagagggaagagaaatgttctataccatcgttttctgattttaaaatagtccctgtcaatcactctaatcctttctatccttgacagctctcttctttcatcttcctttcaagtttttgctttcctctcttaatgactccaagacagcataaaacacaatctggtacagtgtcttctgtctcatctgtttcagaaggtaacacagactgttaactttctactgtatctttatgcaggaggcgctgcagccctcaacctttcagtgaagagatcatttctccttcaacrtgtattttacaactttctacgtaatagtaactgaataaggatctattcagaaacataaataacaaggccaggtatggtggctcatgcctctgtaatcagtcctgtaattccagcactttgggaggcctaggtgggcggatcacctgaggtcaggagttcgagaccagcctgaccaacatggtgaaaccctgtctctactaaaaatacaaaattagctgggcatgctggtgcgtgcctgtaatcccagctacctgggaggctgaggcagaattgcttgaacccgggaggtggaggttgcagttagccaagatcatgccattgcactccagcctgggcaacaagagcaaaactctgtcgaaagaaaagaaagaaagaaagacaagaaagaaagacagaaagaaagaaaggaaggaaggaaggaaggaaggaaggaaggaaggaaggaaggaaggaaggaaggaagggagggagggagggaggaaggaagggagggaggaaggaaggaaggaaggggagaaagaaaacaaaggctactatgaacaaattaacagctttaatcacaacagcataaatatatatgggtgtggctcctgtatgtgggtgtgtgtgtttcatagcctgagagctaactggctatgaaacagtttctaaacaggtgagaaaacaatgcttggtgtgggcctgggtgccttagaccccaaggtcaggacaatgcctgcacttagacacaaagatacaccgttgagaaggacaagtctaagatgaaatccagcccatgttctcatcactaagtctttcaactctcttttacctctttgcctggaagaaagagggtacttttactaattagtttgtccagactggctgccatatagtcttttttctctagtacaaaggcactcctatgccagccctggcccataagctctgaccctggagtcagacagacccggctatggattctagccctgtggtgtggtatttggcaagttaacttcacctctctacactgcagcttcctcatctgtaaaataaggaaaacgatctctctcttttctgcatagggcgactcccagatgcaataggactccctttaccttcatggycttcttgaagctgtaatgaggagataatccctggtccccaggctccattcgtatcttacagaacactattcccctttcaaataggtagatttgcctctggctgggtttaaatcgaatcaaatccttcattttataacgatccttgtgaattgtccagacgctgaaagggccgtgcagcaacagcttgcctagttttccaatatcgtccttttggaaacacacatacaggaaaagaagctgtaaaattacttgacagagaaagaagcctttgtggcctgttttcaaattttataaagcatgcttctttgaggtttacaattctaaaagtgctattcaggctggtctgtcactaaatcaaaacgacaattttttgagcttcactgagcgtggtgccatttagttatataaggaaatcaattcagctatgaaaggtaatgctatacataaagaatgttagaaatgcttgagctagagatacggggactgtgatatttttgactcaattttaactagcagaattcaatttcctctgtgctatgtttgatacatgacagtctccttcaaagggacaagaaattaacatttcaattatgtccagtagagatagaattttggctgcattgyggacccatgagcatctgtgtgttccatctgcatcctaacttctgcttcaggtatatgaggacctgagaaaatgaagcttgttctgaaaagagaaagtttactgtgatctaatcttcacaacattgtaatggaaatagtaactgcattcaactctgagtttttcagagtgagtcaacagtgccaagataataccaaatgacagatttttaagaagtctgtttgactctaggcataaactgtgatgcccctgtctccaccagcaaggctgcctttgtcatatgtctggttgaaagtccaaatgagatgaccctgccttctctgagctctcttcaaaagacagtggaccaagatgagctgggagcgaggcattttatctggtatttttcaaaacttcgattgcttaaagcagataagaattcatttccctgaataaaaacaccaaaaggaacaaattatttgaaggggaccaagacaaagaaatctccctaagtgacctctagctgagatcaatccctatgatttctgagttaatactggaaatatgtacttcattcataattgattgggcatttttataatttattgtttatatgttgggcaaactctaggtatcttttttaaaaaggaattgactttacttctgaaacattaaaagaaaaacttcaagagcaataaactctagtcatttctatggtgtctatggcgttatttcctatgttaattttctattttcttctttggaaaatttacatatgtagactgtggtgaataaaaccctcaaactcccagccacgaggccttctttcctaaaagccaatgctcctgttctgtgttaacagttcaccacattccaaaacagaagggtggataggtccatgaggaccctggagaattttttcactctatctgcatccatcaaggacccactcaaatgtaatcactacagaccttagtgactgctttttcctttaaatccattcaattcataatcaatatcgacataaatagtgcaggaaatatgttttagtaaaggcaactggtagaagtagatacttaatatttgccacataaacaaatgttatcagcacaggttgagcatccataatttaaaaaatctgaaatcctccaaaatctggaactttctgagaaccagtatgacactggaggtgaaaaattccatacctgaccacatgtgatgggtggcagtcaaaacacagtcaaaattttgcttcacgcacaaaattattttttattttttatttttttgagacggagtcttactctgttgccaaggctgcagtagagtggcacgaccttggctcaccgcaacctctgtctcctgagttcaagggactctcctgcctcatcctcccgagtagcttggattacaggcgtgcattaccatgcccggctaatttttgtatttttagtagagccagggtttcagcatgttggccaggctggtctcgaactcctgacctctggtgatctgcccacctcagcctcccaaagtgctgggattacaggcataagccactgctcccggccttcatgcactaaattatttaaaatatgtaaaattaccttcagtctatgtgtataaggtgtcatgaaacataaatgaatttcgtgtttacacttgggttccatctgcaacataactcagtacgtatgcaaatactccaatcctcccctaaaaaaaaaaaaactccaaaacacttttggcctcaagcattttggctaagggatattcaaacttgtagtttctatcttacaatgtattcactctctacctcattttaaacattcgacgcatcttacagaaatatatacagtatagacagatagaaaataaccgagggaattaaggtgaagaaaaaataaagaagttgggagcttggcgcctgcctgtagtcgcaactacttgggaggctgaggcaggaggatcacttgagtccaggagtttgaggccagcctgggcaacatagggagatcaccatccctaaatataaagacaataaatcagatgaactgttccagaaggtgtagaagataaaagaaaagatgaagaggttatatgtaaaatgcatataataaagccatttaaacttgatgtaaacttggctctgactttctaatagcaatacagagggaaacatggtgagtggtacgatttattatgtctgaagacatacacaaaccggttgttcaggaaaagcacagctattcctactaagacataagaaacatttctcccagtgatatgttgtcactgagcaacatcctcaaccacgccctatgatagaaagaggaacatgttttaggtaaagctgcttgtaagaacacatttggtcagtgtggaggctcagctgtcaaagtaattctagaagaggctaggatgataggggaagggggaataagtcgaggtgtacactctctaatgacttgtgaagatggggtgacgtgagttaaggcatccacaaggctattgtagaggaaacagccccaaccagaaatgctgaagaggcagcctcaggcagcaaggtttgtgctttattacctctgaactttcctcatcaccccatccacagccatgctgctgcaccttcataggcaagtaatcagaggatgtgaatccagagaggtaccagcagctgaccatagggcccccagcataaaaacaatgtgccagggktgggggttggcaatgtgatctctccctgaactgaagaaaacaggaggaagtggtgaccagcaggagayggggctgtgagatgctttaggggaaagcaggcagtggaataaacgagaaggaaacagaactatgaagaaggtgagtcattagaaattatgaggaagaggaagaaactgacggaagggaaaaaaacagtcagtaggtggtaagagsgggggcgagcaggcatgtgggtgcacttgacatatacaggcgggtcacacaggtaagaaccccggctccctccccaggcccaggccccagaggtgctgtggatcctgggtttgctcagttcccatctccgcgaacttggctttgccatcgtgacttcttgagaagctgcaggtcagctttccagtaagcccattattactggaagtgactcggggggagtcgctgggtctttcaagtctggcagaaacatatgggcacatatcctctgggtcatgttgcacaaatgttctcaggaccacacatatgacggtattgcccatctccacgcccaaggtccgatctccagcgggtgagcacatgccctacacggtgctgaccaagggcaggcacacacactgttcactgtgctgtgtggagctgctccgcctccaacaggaagctgcagggacattccctgagcaggagcaagaatgaccttttccgtcacgtgtaccttttctttccaactagactgtagttgatctcaaggtcggagaccacgttgcacaacctctttcagatacgtgttcaccagtatttatttatttattggcattccctagtatttatttatttattggcatttagtggtgcttgggagtaggggacaggaaacaaaatactcatcactgtgagggaatattgatttatccaaggagttcattcagcgacgcccctgtactgggttgaatagtgttcccccaaaaactcatgtctatgagaccctcaaaatatgatcttattcggaaagagggtctttgcagatacaattggttaagatggggttgccctgggttaggatgggtccaaatccaatgactggtatccttataaaaaaagaaaacaaagaaatggagacgcacgctgagggaacagccatgcaaaggcagaggcagaaattggagtggcacagctgtcagccaaggaactccaagaattgccggcagtcaccagaagctcagacgaggtaaggaaggattcttcctgagagccctcagagggaacgtgggcctgctctcaccttgcctttggacgtctagccgtcaaaactgtgagggaataaatttctgttgttttaagtcacgtactttgtggttccttgcgacatcagccctaggaaacgaatatacttccaactgttttccaccagtaacaaagaagtgtggccatgtcacacggtgtgtggaagaacctgatggttgtgaactcagagatggaacatagcggctacctcaaatgagcgagcgataagttagatggcctcctctgtacaagaagtgatagcaaaatcaattagtaaatgctaccactttcacacctgggcattctgcaggtaagagccccgatacaaggatttcaaatgtgactacattggccaaatgaagagtctggctgagagagtgaatctagggaagctggcctcagcaagagcttcttttgggtgcccgtgtttccattccaggtagtaagagttaatatgactgtcacaaacttactgcacaaagaagcaggaaacatctgtataaatgcgtccacacagagcctgagtccagaaatgaaaagcagaagctgtgggagcctgtgattacaatagtcaggggcaaagaggtatcttcctttccagcttgagcaggtccccatataacgtaccactagggctgtttattcggcatctgttgggcgccaggcacagtgcttggtgccttacccatcatttaattctcacttactcccggcaaccgcctgtaatataggtattgtgggggggtggggggggtgggggggtggggaatgaagaagatactttgcctgggtcactaggattatttacttagccctatctctgcagctaacactgtggtaaggaaagaggaaactgaaatagaaataaaatcctggccctagctcacaatgaacttacaatacaagtacatcctttagtggtttatataaatttgttccaaaaaggaagactgtttcattcaatctttacaagtcaactttggaacttatccctggcaagtcagaatttaaatgcatctctaatatgcattggatttgaaaaaaaaaaaaacttttgttttttttttgcaaatagatagaagtaaattataactcagtgttccacaaaacaaacttgtttggaaaagaattttaaacttctgtgattaaattagacccaggactaattgagtacacagaaaaacaagaaaatataaatatcagaagggatttttttctagttgctttctagttgtttaattgtgataatttaattatcacattcaatttctttcctttataaaaccaggttaatattaaatttcaagcagagaaactaagaggttaaactggactcagccatgcatatagctgtaatttattacaggtgatcataaacacctgtaataaaactctacaaaatggagacaaagaatctcagaatcatttgagctgagttagaggcagttgtcagtcaattctaatcagaaacagataaagagtggaatagcaccctgatagggaatgaacaagaaatagtccaaggtgacagccatgtaatcttgagtgagttaactcttctttccatggatcttcttttgaatcagaaggttgaaaattccaatatctactcctccataattcaacaggattatacaaaactgtcaggagaaattagctgatgtattagatgtaaaagtaagttaagtcttagtagaaaaggtaccaaaaagcatctggcagaggcacaattctgaggacacatggtcaaaaaaggtcctttgctttttgcgtgtaaaatctccaaattctgtaagctggttcatcctatttgcatgcaaactggctgggaatgaaattagggcagaatgttatttgctcatgttttaaccattcttttctcacagcctcctcctcctatgttatttacactgtttcctgccctgtgtattgtttccaggacattcattagattcagggaaatgaaatttaatagggatgtctaatacgtaattcaagatttaaaaaggaacagaaagatgccctggattgacctaacaaattgttcccttgactttcctcaggcgaagaaagaagaattattaccaagaaaatgatccttatacacaccctaaccctactctgcagtttatgcatatcctcttgaatcatgcatcagttgtcatcagagacaccttggagtcccaggggacagtaacagcatcatggctgggatcacagcaaaccccatggggctaagtttctgagatccaggcccaagaaataccagcgtgggaagtaaaaataactcatttttcggaccttaataactttcatggtttgatttatgacaaggaaagaaaagtcatttcctctaccaagacctcaatacatggtatgttcaaaaccaaataaaaatgaaaagaaaaaaaaagagaaggaaaaagtataatataatcacaagtgacaaaaacgcagaagagggggtcacagagatgtgatgtaagaaaaacttggccgggcacgatggctctcacctgtaatcccagcactttgggaggcggagatgggtggatcacgaggtcaggagttcgagaccagcctgaccaacatggagaagccccgtctctactaaaaatacaaaaaaaaaaaaaaattagcaaggtgtggtggcaagtgcctgtagtcccagctactcaggaggctgggacaggagaatcgcttgaacctggcgggcagaggttgcagtgagctgagatcatgccattacactccagcctgggcgacagagcaagactctgtctcaaaaacaaacaaacaaaaagaagaagaacccaacctgccattgctggtttgtgctttattacctctgctcatagaagccatgagccatggagcgtgggtggcctttttaagctggaaaattccaggagacagatgctagactccaaaaaggaaaggaaacaccttgattttagcccatgagactgtgttgaacttctgaccttggaacttcaaaataataataataatgaatttgtgctgctctaagccaccaagcttatggtaatttattatgacagtgaaataaaacaaacacatctgaataaaaatctagagtacttcaaagtaaaaaacaaaacaagtcgaatattaactatgctccagtctcaaagagatcatacagttataggggatgttttgcctggaatgcctgggaccagcctgctccggattaacactgacgctggagctcaactccccagcattggcctctaactgcatctcttgggttttctttagactatttggattaatgcatgtacactatatacttttggggcctcttctgggatctgtgatataaaattggggcaagaatataggacctgtttccaaaatacttttcttagagaaactctgaaacaagaagacaaatcttttactattttaatagtgccatgagttagaaaataaattgctcctccaggacttttcctctgcccatatatgttctggcccttgactttctggtttgtccagacagtgggtcagtcccacattcagaaccctgaggaataaatycaagattcctgaagatgccaagggacagcttggaatcttgtagtgcgggtttactgagcaatttaggcgactgtcctcagagtccaattcctttaccatagacgatctctctgactttgccagagcatttcctcactgtgtagtattgcacctgccttttgtgtgagatgctctaacactactatggaacataccggacattcagtcactgctgctaggtccacagccaactcacaggacttgatcaaatcctctatcactgccaaagcttgttgtagttcagttgagaatgctgaatctttggttctctttggcccatcctgtggaaaacaaatgccttgttggaaatcaaaagtataccatctgcaaagtgaagaaggaaaacaggacagagatgaggagccagggatccagccaaccctgactgagaagggtggatattgatctgtctccctgctcccaaagcatggtggctaaagatgcttactgatttaggtatacggcatagagacaagcaaaatcatctacctctgtgcattgtactagtgacgaatgaagttcataaatcatggaaattatattcctgctacataagaaacatatagaattcagctatatagctgaattctatatgtttcttatgtgtatatatattatataaatatttatatagtatattaaatatttatatattaatatataattatatgtttatatattaattatatatattaaatatttatatattatatattatataaaatataagtatatatattatatatatatatatatatatatatatattttttttttttttttttttttttttttttttttttgagagcgagagagagtttcactctgtcacccaggctggagtgcagaggcacgatctcggctcgctgcaacctctgcctcctggattcaagcaattctcctgtctcagcctcccgagtagctgggattacaggtgtgcgccaccatgcctggctaatttttgtatttttagtagagacggagtttcgccatgttgaccaggctgttctcaaactcctaacctcaggtgatccacccaccttggcctcctaaagtgctgggattacaggcgtaagccactgtgcctggccagaatttagcttttttaaagcatggaaaaacctagctccttttaaataggcttctctctcttttatacccctattccctggggcttactgaaaaaaaaaataccatatggccgggcgggtggctcatgcctgtaatcccagcactttgggaggctgagacaggcagagcacttgaggtcaggagtttgagcccagcctggctaacatggtgaaaccccgtctctactaaaaatacaaaaattagcttagtgtggtggtgggcgcctgtaatcccagctacttgggaggttgaggcaggagaacagcttgaacccaggaggcggaggttgcagtgagcccagattgtgtcattgcactccagcctgggtaacaagagtgaaaccccgtctcaaaaaaaaaaaaaaaaaaaaaaaaaaaagtagctgggtgtggtggtgtgtgcctgtaatcccagctactcaggaggctgaggcaggaggattgcttgaacacgggaggtggagtttgcagtgagccaagattgcgccactgcactccagcctgggcaacaaagtgagaccttgtctcacaaaaaaagaaaaaagaaaaagaaaaagaatacaatctgagtatcatattcctatatttaatgtggaagccttattcctgtgggaaaaattatacttaaaatcatcccagaggaggacatttgtaaactcctatagagacaaagaactccatagaggctgctaagtggaaatttactaatgatttacatgtaaaagctataacatcatatttccacactgaatctcccccaactctgtccttccttcctccacttgtccctggccctccccacattgcaccaccattaaagatgccaaagagataagccagcgctctgcacctcccgaacataaagactcagcattcagcggaaaagcagtaactaattaaagagaccaatgttccaattacaaccacagtgacatttaggatgtgattggggtgattgtttcagctctaaaggcttttgcatgggcttgaggtattttatctccctgctacctacatgctgtatttatctgttacctggtaaatacacataaaaaaattttggtttattcaatgtatttttttaacatctcaagttctgcagtgaagaacagctagcccctttgctgctccgcatctggccctgactctttttgtcctctacagcacaatgtagtcacagggtttaatattttcttaatctatgcggaagcactgggtatttgcatctttggatgagagacatgagtgacagggctgatgaatggaatagatcgtgctgctgcctctgaaaaacgtatcatggattcgtagcttctcattcataataaagaagcttcgcttcctggtaaaagaaaacagactctcacctgaatttattttaacaacatcaataagggattaagagttcttggcagggcgcagtggctcacgcctgtaatcccagcactttgggaggccgagggggggagtggatcacgaggtcacgagatcgagaccagcctgaccaacgtggtgaaaccccatctctactaaaaacaaaaattagccgggcgtggtggcgggtgcctgtaatcccagctactcaggaggctgaggcaggataatagcttgaacccgggaggcggagttgcagtgagccgaaactgcgccattgcactccagtctgggtgacagagcgagactctgtctcaaaaaaataaaaaaataagaaataatttttttttaaagttcttataccaggcatcttcctccttaccaaacactgaatgctcagtttcctttcagatcctcacctcttcccatcccccttccttccgctaaccctccttcacaaaacacgaggtggctagggttttgaactgtataatgtagggttcagaaaaatcctttaaaacattattaaactcctctaactagggctagctcctcttgctccaggctgtaaaaatatgacctgtgtcctgagctgcttctgttttcaacaggtccttgtcatccattctgagcagaaagggcatgcaaatgactgccccataagacatgtctcaagtgtttcttgctaaaaccagaatattctataggaaagggaagagaaaccgcactgctatamcacagatttcttcctaacctggtgtggtcatggtcaccatttattctaagggaactttggcagactcttagagttcacacacacgcacacacacacacagaggagaacaaggcataacatatagaaattagatatactaagaggtacaaagaagaaaacataatcctaccattcaggaaagccacagcagacattttatcatatctatttacttccagtcttttatgtatgcattttacgtatttgcttaattttgttcccattaaaatttttttggctgggtgcagtggctcacgcctgtaataccagcactttgggaggccgaggcaggtggatcatctgaggtcaggagttcaagaccagcctggccaacatggcgaaaccccgtctctactaaaaataaaaaaattagctgtgcatggtggcgggcacctgtaatcccagctacttgggaggctgaggcaggagaatcgcttgaacccgggaggcagaggttgcagtgagccaagattgcaccattgcactccagcctgtgcaatggagtgagactttgtctaaaaaaaaaaaaattatgtggaaggaagaaaatatattaccacttccatttgggctgcaaatccctactttaaaattgcctttaatttttttgttttttttcttgactgtgagttataggatacatactattttagaaaatctagataataaagaccaccaagtaaaattgctataaatcctccgacccatagacaaacaccattaatagttagttatataaaatgtaatatttaatattgagtaccttagccgagcctcctagttcacctgggtctatctccatatcttcaggagactcgaaatccagcagaccctgcattaacccaaaagtcttgttgaaaattaaaatgtacattgccatcaaaatgtagattgtcaacaaaatctactgtgcaaactatctgccaccaatgctaagctgactgagaacgtgtgtaaatgtgtaagagggaaagaataaatgatgtatttggcacagggtcctttccacaaacctagaatcatattgtacacactattttgtagactactttttctcattcaaccatacctcatgaatattttcccatgatattatgtttttctaaaatatgggctttgattgtggtagagtgttatatcttacagataaaccatttttctcattcagcaatatctcatgaatattttcccatgatattatgtttttctaaaatatgggctttgattgtggtagagtgttatatcttagagataaaccatttttctcattcaacaatatctcatgaatattttcccatgatattatatttttttaaaacatgggctttggttgtggtagagtgttatatcttatagataaaccataatcgaattatagtcccccttatcattaaacatttaggttcaacaatattttttactataataatgataataacttttgtgcatttttcttaaagctaaattcctagagtggaattgtaaatgttaagagttttgaggcatatttccaagttcttcagagaaggactgtcttcctgccagctgtataggaaagcctgtctcaccagcccctagcctacaaggggtagtaccatttaatcaaaaatctttaccaattgaatgaaaagagaaatcctacctcactgttgttttaatttgacttccttagataactagaggtgtagaacttttttaaaaaaacgtttgctactagtgtttattcttttgcaaattgctatgtcctttgcgcatctttttattataatttccaagagcacatgattcattaagcatactgatcatctgttacatattttgttcacattttccccaatgtttcatgagtctgtctttaatggtataagctatcactcatcaccctctccccaagatcccatgatcctttctaaagcatgaggcaatcagtccaacattcatgctctttcaagccagcacatgtgtgcgagatgcaaaataagctctgcccctggggatagagaaggtcctagataggattacaaggtcgttcctttctttgcaggcacgtaatggcctgagctggtttcacaggcaccagcaagcttagctgtggggacactgctctggtctgccttgggtagctcccacggctcctcacagaccccccgcaaaatattttgtagtaattctatctcttgtttcttcagtgaaaggcagctaacaaaaccttctaagtccttttaacctgtattatctcatttaatgctcccaacaagcataccaggaaagtactattattatcttatttctataggtgagaaatctgaggctgagagaggttaagtaacttgcctgagttcacgcagcctggaagggtcagagcctggattcagacccaggttgttaaactctcgagtctgtgtttccaatgacgatgccccacagccctctgcgtctggtaccgaacctagctcctatgtaaatgtcacctctgtgggaaagctggaacctaggctgagggaggaaggaccatcactttcgtcctgctcatgcctcactgggcccagaggttggacttctacaataggaatgacagtgacaatgggacatgcagaggagcatgaggccctgagtgagtgctgggtcaaacatgctctgaggtgctgctcgctgaaagaagcagatcattatcctcatttctatggtggtgtgacagtctcaatgtctaagataacagctacacatcatgcagagcttcctgggctgtgccaagccctccgcatgtgctaatcatctgcttcataacgatcttatggaggaggttctagtaccctcattttacatagaggaaaactaaggcccaagaggkcaaggtctcataactgacaaatggcagagtacaccgaggctgaaactgctaatggaaagcttgaaaggagtaactttgaaaaaatgtttttaaaattatttttacagatgaggtcttgctatgttgcccaggctagtcttgaactcctggactgaagggatgcctcctgcctccacctcctgagtagctgctgggactacaggtgtgtgttatcatgtctggcctgaaaggggtaactttttctgaggggagactgttgggcaatgagcttaaccttcctgagcctcagtttcttcacagtccagagcatggctggtatgtctgattgtggagattaaataagaaatactgtaatcccagcactttgggaggctgaggtgggcagatcacgaggtcaggagttcaagaccagcctggccaacatggtgaaaccccgtctctactaaaaatacaaaaattagccaggcatggcggcgcgtgcctgtaatctcagctacttgggaggctgaggcaggagaattgcttgaacctgggaggcagaggttgcagtgaactgagatcgcgccattgcactccagcctaggcagagtctcactctgtctcaaaaaaaaagaaagaaagaaagaaaaaagaaatacacgtggggaagtacccagtaaacagtaggtgcttgtttttgtttttgtttttgttttttattaagaaatagtggccactgggcaagagctacctaaatgccttatagaggttaattcaacagacaacttatcgtggtggcccaaacctttctctcaagctcacacctagaaaaccagccatgataggccctcatatcctgtttggagtgtctgagaatgcttgcctgcagatgtgctagtgtcaatgacttatcactaaggaggggtaaaggtcagagagagagagagaaaaccacttaggggttcagggttcagatatagcaaagttcattctgttaggctgctctcagggtaagatcctaaatctaagaatggaggtcagtgctgcaaaaggatagaagacttcagttttgtcttctcccttccacaagttaaaatgcccataaaacagtaactttggggaaaatcacactctcgctcccaaagagctctcttcccctaagccagactccttagtgattcatgccctgagctagacattggactagtgaggccctcaggtgccctccaactctatgattctttggtcttactccacattgaagagggctgatttagagttggaggaaagaaaaagcctgcaggatagacgtatcttcagccttagaagaccaaggcacagctctacatgtgtaacgacatgggcaccacagtgcaggcgtctggtttcccaccaaggaaaagcactgtctcattgattttaccttcaacagcatctggtattttataagtctctggcttggtcctttgagatacttaaaaagagggagattgtgatccagttggcgctggcatacctttaaaagccaaatagaaacaacataaagcaaaacaaacaacacacacagaataaaagtggcagcatttaggtacaaaacacaaaattgcttttcctggacaacaggggcagctgtgtcgagcagctccataaggctgtggggttgttctttcccctaggaacagtgtgtgaaataagagaaagaggaaagaggacggctcggctaatatttttacaggcatctagggaagcagaaccatttatttcttttagaaagcaagttcactagaagacagtggggcatttcaagtccttctgaaaaagaggccacctatcttcaagttgggggctgccagagtctattcaggccttttggagcctgaaggatacagacggtttgtagacatcattccagggagcccaaagtgtgacattttttacttagtttcatttttaaaacccatcttagaagaagacactggttttctcaccagatataggtgctcctcacaggcctatcccattacaacttttcatgtgtaatttcaaagtatgggacactttaaataaacataaatcgcaatgccaagttcctctccctagtcccacttttgatttctttaacaacttgatgcatagaaacattttccaggaagaagtttgtcttctcaacattaccccaaagtaggcgcagtcttgacactcttgccagattgccctagctcggggcagattcttatggtatttaaaatatatctgaagatcttctttctaggtgggaaaaaattagaataaattaatcaggcagcatttttcagtaagtggacaggatgatacagtttattcattcattcaacaagccagagtattctaatgtgtaaggaattgggggtgtacagtaagtaatcttatgttgggatgtgtgtgtgatggagagataaacagaaggctttaaacaaccataactaccagacatagataggcacagagtgctctgggagcatctacaagggctattggtaaatacataagtagactcacaaacaggaattggtttttatctttatcattcttttcctgccctttgtccaggacatcgacatctccccacaacaggtctgcaatgagtagtaaaactgacagaaaagaggctggtgtttgatggtccccctctcttctctctccaccctctccttgtggtcatcgtgacaccaaccctgcaaagaagcccaagaaacaaccaaaagatggaaacatgccagaggggagatgtggtagatcgggcaaccaatacggagctcagtcatttgggcaaccctcaaagtgacaggctccgcctcaaacatcactttcaacctgcagcacaagactctgagacaggaaatgttatgtgactgtttcggagctagagagcaaggaggactcaacgtgctgttcaacctgtattctcatggtatcaaagacgctgagaggtgggcacatatctgccaatctcccggagagaaagcacactccaagcctctggcgtcagcttgccagcttcactcgctctatcagggagcctggcccacagcggctgtgctggccacagatcccatgccattctggtggagaagcccatgtagccacctccttgcagaagtctgtgtccctgtcctcctgctcagcccaactctggatttccttcatgtcaacacagatgattccttccctctcagcttcaatgatgcctgttctactcccaaatacattgctatagtggatgacttccatttctgtagctctttctttctcccaataggttgtaagtggtcatttcagcataggaactacagcaaccgtcctttgctattccctccaggaaaaaaatggcacacacatttaagacagatggcccttgaaaaatgttcagactggttaaggagctagaataataactcagagcttaacaatatagtattgacctaaattgctcttctaaaggctaacagtccaaaattcctcagagaaaggatgtccactaaccagcaacatacaaaagtgcccaattctcctaatctccttatagaatgaatcaggaggctataaaattgctaccagaaactcatattcacacaagaatacatacttgcttacggattaagactgcggggctctggtggcggatggtccaggttcagttcttggctttgccaaatacaaatcatatggcctaaagtaagttacctaaccttcctagacttcagtttcctcatctgttaagtgggcccataacagtagtcaactcctgtgactgttgtgagattaaatgagatgatgtatagaaacctctccacaaatgcccaatggatagagtactcaaaaaatggtggctattgtcaaagcactttttactttatggaatcctctgcatacattattttgtttcccacaacaactgtacatattggtactattagcctgttgtgtggaggaggaaagtgagattccaaagtttaagttatttactggaggtcatgcagatagcaagtggcttgaccaacatgataaatcgggtttcctgacttaccagttactcccacatatcagtgtgagcacccattccagtgctctttccattttaccatgtgagatctcagagtacttggaacccacagtacactatggacaaatattattctatatagaacatggtctctggaggagaattgtttcagaagatacaggctaaagaggctgattaaaacacttggtcagaaaactatttcaaaattcattatcttggaaggccgaggtgggcggatcacgaggtcaggagatggagaccatcctggccaacatgatgaaacctcgtctctactaaaaatacaaaaattagccgggcgtggtggcacatgcctgtaatcccagctacgagggagggtgargcaggagaatcgcttgaatcagggagtcagaggttgcagtgagccgagatcacgccacagcactccagcctggtgacagagcgagactccgtctcaagaaaaaaaaaaaaagtactacttgtattttgtctctaacatcataaatcacatagggctaagtcagtgttttctggctgggttaatgatttacaatgttcctcccaacatggcggggcgctatcaaaaaactttgtaaaactttacaatttaggagaggaattcagaaaaggtatttagttaataattctctgacaatttcctcatatttgaacaatttgataatatccactttcccacaggaactttgcccatttctcattgagcaatttaaataatctttgcagtaatgacatacataaccataaaatacttctaatctctgaaactagatttcacattagtcgtttgttaagtgcaaaaattcaaaatagtatataaagcactaataatgtaatagttcaaaaaaattaatgaatcagaatgagtataaaatagttttcagtgtacattgaattctggtgctttgacacaaagcctatgatgagttgacatggaaagccatatggggccaccaaaaggctctgagcatggaagattccttctctccattaatgtcaaatatcttgaaacctggaggctttgtttgcttccagttatcataagtattgctctcagcctcagtcataatatgagttgcttacaactttaagttgtttgatctgttgccttgggttcacaaaaataaaaataagaaagagaatgagaaggactagttgagaaagagaggagaaatgagaactatttagaaggcacagggggtcaggatcatctccatggtcgtgtcctagaaagtacctggtggggattgatgttgggtggaacatttctctgtggcagctcccactggcccatatagcctatttgttgcctaaaacagggtggagaaacagggaaagagggaagaagtctgggaggtgggaagaaggggtagttggaggtataatgttgtaggccaagatgttcataaattgagtactaagcctaaaggaggctgtagatttagaattttcgaatcatcctctatgttgtaaaaaatagaatggaaagaaaatgtatttcctgaggtttttagtttaacaccagtgcttctcctcttgagagcattagtacagctttattgtgggactctaacctcgctgtatgattcttgttttaaaacgtagttgagtcattcagaagaggatcctctgctttggggaccatggatggccagccttccatttcatggggctttgcaggaagccaggcttgcggttactcccacatatcagtgtgagctcagtcaaattggactcattctcaccttggataaagtcagataaagttgggaggccaactcatgttttccattcaaagggcagatacaagatatactgtcttgacaaattgcaagtgtacagtacagtattattccatgatagtcgccatgctgtgcgttacatctccaggacttactcatctcataactgcaagtttgtaccctgtgaccaacatctccctacttcctctagactccagcccctggcaaccacccttctacttcaatgagctcaactgtttttggattatatatatatacatatacacacacacacacacacaatggtaatgaatgtattcattaacttgattgcagtaatcatttcacagggtgtaagtatatcaaaccatcatgttgtatagtttgaatatatgcaatttttatttaccaattatacttcagtaaagcttggagtcggagggaagcagatatgtttttagaccattgatgtttccatttgtccttgccacttaacgcagaaatgtaagggctgactttaacatgattatttactgggagtacagacttactctcttgagaaagcaatgtgccagaagttcagggttctcagcacacttttccaactcttttagaaaagtcctagaaaaataaaagtatacaagtaataatgttttgattttgacatgtaggtaattaattttttaagtacaatcacataaggtttcaagaggtgcctagaaaaatgttctccaggccttcttgctcttatcttctacacattgattcagraaaaaaagctgtattctgaggtattactacaattaccctgaaatcactcacaactttaagttgttcgatctgttgccttaggttcacaaaaagaaaaataagaaagagaatgagaagaactagttgggaaagagaggagaaatgagaactactcagaaggcacagggggtcaggatcatctccaattatcagaacacagctgttcgggtaattctaagcactagtcatagatagactggatacattcactgatgctctctcttacatgaaagtaacgttcataagaactgctgctgctgctgttgctattactaatatcattgacagcttactataagccaggcataagctaagtgctccgcaaatagtatctcatttaatcctcaaccaaagatagggttttataaatataaaacctggggctcaaagaggctacataacttctctggggaaatcaacagaaatgggtttccatttcagttttgcgtctgaccaacggacgaggaatggggttaggaagcaactgtggttcaattcaccaagcagcttttctccctctgtgaattaggtgtgcaatcttggggtcatcatagcgaataaagagagttaacaagttaccattcccatatgtgtaacatgaaagggtttgaagatgatttccaaagtcccttattcctgcaattctctagaactcaatatccaagcagccccgagttaaaagtacaacttgtttgagcagtcagcattttctaacaccctagttcccagcatccccttatgatagtagtatggagatgtgtatcttggtcatctttgtattcccaatgctgagcacagtgcctggcacagaacaggtgctcaaaaaatgctgatgcatgaataaataaacaaaggaacactcaactgcatacaacatggatgtctgacactgggtccctgttcctttgatgtctcttccctttctctccagggatcctgtggggcttctcccctcctttcactccaacccaccccaatccaatccactgactccaaaccacttgcttaaacctgaaaacatctaagtgttttcatctctcaattccatcagtctcatttccacccttctsttactctccattctttctgataacatgaattattatatacctgttgtgaaattcgtaaagttctctaatattcccaaagagaaagtccttgttattctgaagaacatctggaattagatgctttagccaaataaaatccattggagtgatatatccctgcagaggtgcaaacaaggtaggtgttacaaacaggaacataccagagatcatctgaattagctactgcaaaacccaaaactttagtgaaatgattgaagaatatagcacacttgtttcttgaaagctatcgtattgagtactttcttttgatatcattttcctcatgtgcccactttcagaaggagatggcttaatggcaatgatcataaaatggcatttttgtgggaagaacaaatatatttaaaaatgtttatgttacacaggtttaatctaaaagaagggaaaatgtacccactgttttatgaactaatacaattactattattattatgattattattaatattgagacgaagttttgctcttcttcccaggctggagtgcaatggcgtgatctcggctcactgcaacctccgcctcctgggttcaagtgattcttccgtttcagactcccaagtagctggaattacaggcacacaccaccacacctggctaattttcgtatttttagtagagacagggtttcaccatgttggccaggctggtctcaaacttctgacctcaggcgatccacccgcctcggcctcccaaaatgctgggattacaggcgtgagccactgcatccggcccaataattattttttaatatctgaataatgtttactcagcatatatatcatagtttactaaacattccctttttatggacatttgggttgcttctaatattttatggtaaaaatgtgattataaataatcgcgtacatataattttttccttaagattattcccttaggaaaatagggaaaacatgcatttttactcttaagaaaaagactactttaaaaaaacaagaaataatcttcccttattaaagtatcaggaacacttataatatcctttgttggcaagaagatggtaaacctatttgggctttgctggaatcagtgtgaactggcttaattctttggaaactatttggctacatggatcaagaaaccacagggatgttcttattcctactggagacacttgtaatattctaagacctgaaaccttggtgggaattctggagacttctggcaactattttgagtctctttgtacaacaaaacatctgcagtttgaatatatgcttgataccccactccccaaatctacttacatcaattatgcttttaatctcttttatgtaaatctcttcagtctcaagcaagtcacgtataatgcgcctgaatcacagcagcaggtgggagggtgaaagagagagagacagggagaggagaatgttcttttagaattctgttagaataatgctcatcaatacagttcccttttagtggctcacctacttagtttctggtcagttcattctgttctattgaacacccaaggtcagcatctcacaaacgcacactgtgatcacactggtatcaagaagaaacagcaaggttagagaactcaaaatcctttaggcagccagtgaatgacctgtcctctgggtgggccatatagtgtgggggtcaagaagggagatgttggagtcagaaataccaggtctggatccttagtcaaggaaggtctgcctgaccccacccccaccccctatattgtatacattgtataagtggtttcctagattttctctccagctttctgctcacatcaagctttcttttccttttaagagaaagggtcttgccctgttgcccaggaatgagtgcagtggcatgatcatggctcactgtagccttgaactcccgggctccagcaaccctcctgcctcagcctcccaagtagctagggctacagatatgcaccatcacacccagctaacgcctttttttttttttggtagagatgaggtcttgctatgttacccaggctggtctcaaactgctactttcaagcaatcctcctgcctttgcctcccaaactgctgggattataggtgtgagacactgtgccaggccagatccagatctttgacccatatggatgtattttgttgtacatggggttagatgtatgctagctccttcctctggcattggatgtttcactgtgatttcctaaggcaaaagatatgacttctgtctgcttctgtcaaggaatgcaggtggaagatgtggtggacagaatttaagacggtccccaagacttctggccccactgcacatacgcctcttccaatcaaacactaatttaggggatgctgtggaaggattttgctgttcatttgataggtaatccagttgggcctgtcctaatcatatgaactcagatctatmtgggtcaagtggtcagagactggaagcataaaaaagattcaacacaaaggagattcccctttgctgacttttgagatggagggggccagatggaatggaatgtgggcagccgtaggaactgagagtggctcccagctgacaggcagcaaggaagggaaatcagtcctatagttgcaaggaaccgagtcctgccacaaccacgcgaacttagaagaggatccagagctccacatgaaaacacagccagccaacaccttgactttagccttgtgggactcctgtcccagggaaactgtaggtctcctaagtttgtggtcagtttttatatagcaatagaaaaccagtagaaagagtaaggccagtccccacatctatcccagacagactttctttctctcctcaggctacgtggccatatttattatttcttttaggagtccaagtagatgagtgtttatacatgtgtccttgtgtagaatatatatatttattcttgttaactattgatggattatctattaaatggcagcctctcctagaaaatgatttgtttttctctcataaaaatggatgtgacaaatgatccaatagaaaaaaatgggaaaggacacaaaataggagattcacacaaatattcaaatggatatgagactcgtggaaaaaatactcagtacatacattcaacgaaggcatattttaaaagagcaacaattttcatctattagaatattaaacatttcaaacctcatagaaagactggtaaatgagggtgtggaaaaaccctcacacaatattggtaaaatgtgtaaatttgtgcaagctctttggaaggtaatttagaaacatctcacccaaatgtaaaacacgtgctccttggttcagtaatttcacttctaggaatgttcattgtttataattaggacaatataacttcaacaacaaccagatataaactggttacttaaatgctcatcaaaaaattatggtacatgggccgggcatggtggttcacccctgtaatcccagcactctgggaggctgaggcaggtggatcacttgaggccaggaaatcgagaccagcctggccaacatggtgaaaccctgtgtctactaaaaatacaaaaaattagatgggtgtggtagcgcatgcttgtaatcccagctacttgggagggtgacgcaggataattactcgaacccaggaggtggagattgcagtgagccgagatcacaccattgcactccagcctgggcaacaagagtgaaactccatctcaaaaaaaaaatatatatatacatacatatagatatagatagatatatgtgtgtgtgtgtgtatatatatatacatatatatggtacatacatataatgatgaaataccatgcaattgttaaaaagaatgaggctgactaaaacactgatatgacagaggccaggtatttttagtgaaaaaacaaaacaagacgtagacaagtaagcatagtatgactatttgtgtaaaaaatgaatgtgtatgtagaaatatacgtaaaactgtatatgctcagaaaatttatgcaaagaaacttaacacattgttaaaagtgattgcttttggagagtggtactgaaagctaaagtatgggaaaggagaatttctacatcttactctatacccttctacaatcttttttaaagtgaaacatttactgcttttataatggaaaaatagggtttacataatattttaaaatgaatgttactggaggtaatgatatgtaaaccctatttgatagatataaataaataatacaattcacatattttacagctcattattctttcttataatcatttttgtgtctatttataaatacttgtataagacaagactgataaacaagatgtaccacagaggatgtaatttccggaagtctaaaactcccaaaaagttacttaaacatcatactttactaagtcactgagaaagaggttcctatgccttttataaatcacccggaaacaacaacggtttctatgtcagaaggaagtacaggcctcaataccaatatgtttctacgagccctggcatcaagtgggaccacagcaacagttaagcattcatggaaaacctgagtacaatcagcctcttatgccttcatgaagcactgggcttaagcaacttggcaagctggcttcaggatgcattgacaattaaaggaagtcagaaggcagaaataaccaggaggtggacagaagtcaaggttattatccaaaaatgatctatgaacttaagagactcttaggagcttttaggactctaatacaggaaaatattcacatctctgaaggaaaagaaatcccttggtcatattctggattacagtttggaaaaaaagtctagaaatctcatccaactgcttcattttacctgttggagtgcaagagataaaatgccaaggataggaactccactgaagaatgtaggcaaatcaatattcattaaatacattcaaattaatatatgacttaaaaagagccctcacatcagtgttaggccattgcttttccttgcttctcttgttttcctttcaaatacctttataaaataggagaaaatgtatgactcttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccctctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcataatggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaagttgcctgttcactctgatggtagtttcttctgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcgaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaattccctgctttattattctaaagcaagcttgtccaacctgcggcctgtggcccaacacaaatttgtaaactttcttaaaacgttatgagattttttttgcgattttttttttttttttttttagctcaccagctatcgttagtgttaatgtattttttgttttgttttgttttgagacggagtcttgctttgttgccaggctggaatgcagtggtgcagtctcggctcactgccacctctgcctcccaggttcaagcaattcccctgcctcagactcccgagtagctgggactgcaggcgtgcgccaccatgcccagctaactttttgtatttttgtagagatggggttttaccatgttggccaggatggtcttgatctcctgacctcgtgatccaccctccttggtctcccaaagtgctgggattacaggcgtgagccacctcgcctggccagtgttaatgtattttatgtgtggcccaagacaattcttcttcttccagcgtggcccaggaaagccaaaagattggacacccctgttccaaagcatgtaattttattcacagaaaagactctcggccgggcgcggtggctcacgcctgtaatcccagcactttgggaggccgaggcaggcggatcacgaggtcaggagatgtagaccatcctggctaacacggtgaaaccccgtctctactaaaaatacaaaaaattagccaggcgtggtggtgggtgcctgtagtcccagctactcgggaggctgagacaggagaatggcgtggaccccggaggtggagcttgcagcgagccgagatcacaccactgcactccagtctgggcaacagagcgatatccgtctcaaaaaaaaaaaaaaaaaaaaaaagactctcaaggatttaccatctaaaatcatcaagtgtatatcatgcagatgaacaacagaaaacactgggagtattcaagtaattaaaaataacctttcagcaccaacagcaatttctgtcctgatggcaatctactcagagctagaggactgcacttaggataccaaagggagcttaggatgcaagagcagcctgcactaatgtactctgcgttagtttacatccgggcactttgctttacgtttcaaaacagacgccgcccttagctcattaaaggggaaatggaggtataatgtgttttaaagggatgtttcttctctgaagccatatttcagggtagcatgaaaacagagctttggatatctggttccattctacatgacacctcatgcttgtttcaaatgacaccacaaccaaggggcaggaatgaaaggaatatgctaaaaaaaaaaaatgcaatcctttttagcaagaaagatcattaaggatttcctgataagtttcttctttgttcatgtgccctcctctgctccccctttgaactactgcccctgtcacccccccttccccgcctccccgccgtttctcagttctccaatagggatccagtctgccagaggtctatttttgctcattattgtcaacacaatttgccatcaagagttttcacttactcctgctatcctatcatcacattatgcatgtcagaaagcattacagatttttacttttcaagaacccgaactcagatttccaggcttctgtccttcctgtttcatgctgttgactctcccacatctttgtcttcctcctagacctttggtcactcttgagcccacattgccaatggtctatatcattttcacctggatgcctcccagacacctcagtcacatcaagttgaaatagaactaattagacagaagtagcatgtgtttcagtggaactgacatttttctagggtccctaaaacacaggtgttgtttcaaactcccccctccaacatcccttatattctctctgtcacccaggctccttatatcatctctcaacatgcttcctgggtgactactgactctccacttctggtgacaccccacagagcaagctttcaattcctgtcatttaaacactttagtgcactcatagaatctcatccttctgagatttctcttccaccagtctattttgcagaccaccaggctacgcccttccaaaagctcctttgagatggagtttcactcttgttgcccaggctggagtgcaatggcatgatctcggctcattgcaactgccacctctcaggttcaaatggttctcgtgcctcagcctccccagtagctggggttaaagttgcctgccaccatacccagctaaattttgtattaggggttttaccatgttggccaggctggtctcgaactcctgacctcaggtgatctgccacctaggcctcccaaagtgctgggattacaggtgtgagaaaccacgcctagtcccccaaagctccatttttatcctgtcttcattctctcttcaagaacttgcccacagctgccagagttccttctaagagtttaagactctctgttcatgtggtaagaatcttcttaaggagcttgctttaaaggtaaaaccagatttacacatcagaatggggagaggtgggtgggagctaagatggaatctgtaattttcacaagtgccctggatgattctactgcagatggtctcctattcaactaaatagcactcatctgacccactccttttagaccccacttctgttaagccagtgttatcgctattttccactttctttcaagttctaatcatccttaaaactccaacagcttcagctgaaatcagtaccacactctcatccttgtttcccacccaaaaactattgtactaattgaccagacatgtattgatgccctactatgagcctggctccatgataggcacttgggatagagaaatgtaccataatcctgaccttaataaatttagagtctaatggaagagataaaaaaaatcaatgattccaatgagtgtgataaggtaaggctagtcagaaaagtcaggtgcagaggaggggcaactaattaaaccaggggttgggggagacactgccaactctgtgttgagtgaagtttaagcagaggtttttctttaagtaaaaaatcagtttttttaaataaaaagttttttaaaaagtaagggggaatagaagaaggaggtttgtccctaaggggaacagtgtggaggaggaaaggaggtgaaagtgtatgctattctgtgtactggcaaattctttggtgggtgatatggtttggctctgtgtccccacccaaatctcaccttgaattgtaataatccccacatgtcatgggagggacccagtggaaagtaattgaatcatgagggcaggtttttcctgtgctgttctcatgatagtgaataagtctcaggagatctgatgattttataaagggcggttcccttgcacatgctctcttgcctgccaccatgtaagacatgcttttgctcctcctttgccttccaccatgattttgaggcctccccagctatgtggaactgtgagtccattaaacctctttcctttataaattacccagtctcagctatgtctttattaggagcatgagaatagactaatacagtaaattggtactggtagagtggggtgctgcagtatctgaaaatgtggaagcaactttggaactgggtaacaggcagaggttgaaacagtttggagggctcagaagacaggaagatgtggtaaagtttggaacttcctagagacttgttgaatggctttgaccaaaatgctgatagtgatatgggcaataaagtccaggctgaggtggtctcagatagagatgaggaacttgttgggaattggagcaaaggagactcttgctatgttttagcaaagagcctggcagcattttgcccctgccctagagatctgtggaaatttgaacttgagagagatgattcagggcacctggcagaagacacttctaagcagcaaagcattcaagatgtcacttgagtgctgttaaaagcattcagttttatgtattcacaaagatatggttcggaattggaacttatgctcaaaagggaagaagagcataaaagttcagaaaattggcagcctgatgatgtgatagaaaagaaaaacccattttctgaggagaaattcaagcctgctgcagacatttgcataagtaagatggagccaaatgttaatcaccaagacaaaggggaaaatgtctgcagggcatgtcaaggacctttgtggcaacccctcccatcacaggctcaggcctaggaggaaaaagtggttttgtgggcccagcccggggacccctgctctatgcagtctagggacttgttgccctgcatgccagttgctccagccatggctgaaaggggccaaggtacagctcaggccattggttcagagatgcaagcctcaagccttggtggcttacacgtagtgttgggcctgtgggttcacagaagtcaagaattgaggtggatgtacagaaatgcctggatgtccaggcagaagtttgctgcaggggtggggccctcatggagaatctctgctaggggagtatggaagggaaatgtggggctggagtccccacacagagtgcccactgggacactgcttggtggagctgtgagaagagggacaccatcctccagactccagaatggtggatccaccaacagtttgcaccatgtgcttggaaaagctgcagatacccaacaccagcccatcaaagcaaccacaaggggggctgtaccctgcaaagccacaggggcagagttgcccaaggctgtggtgggaacccacctcttgaatctctatgagacatggagtcaaaggagattattttggaactttaaggtttgactgctttattggatttcagactcgcataaggctgatagcccctttgttttggacaatttctcccattttgaacaggtatttttacccaatgtctacacccacattttatctgggaaatagctaacttgcttttgattttacaggcacataggtggaagggacttgccttgtttcagatgagactttgaactgtggacttttgagttaatgctgaaataagtctttgggggactgttgggaaggcatgatttgtcttgaaatgtgaggacatgagatttgggaggggccggggtgaaatgatatggtttgtctctgtgtccccagcttcatcaggatcctcccacacatccccattctaagttgcagggtcccattcttttccaatcaatgccctcattttaacagtagacacctggtgaggctgtgcatgcacctttcattgcaggtcagccgctcccatgataagagcttgtatctgattttccacaatttcagctctttctctacaagagataagactctcactctggacaatcttagaagatttgaggctcagtgtatgcttctggagctgggagttagaatccctaagttcatggttttcttctatcagtttgtccagtgaacttaggagcaaccaaccaacttcgttatattccttggtcctctatatatggtcaaaggtattatgtatagagtcattaaactccttgcctctcatgagtggtgaatcaggagtactgaatgcatttcttttgcataagtgtttgaacagttcgtgccaaggactatcagtgttctccacacaattagaagtagagtccttagcattttggggtctaatcatattaagcaaccaactccagaaacccaaaaaccaactaaagaaatctatccttctgtaatcccagcactttgggaggccaaggcaggcggatcacgaggtcaggagactgagaccacagtgaaaccccatctctgctaaaaatacaaaaaattagccaggcatggtggcgggcacctgtagtcccagctactcgggaggctgaggcaggagaatggcatgaatccaggaggcggagcttgcagtgagctgagattgcgccactgcactccagcccgggtgacagagtgagactccagctcaaaaacaaaaaaaaagaaaaaaaagaaatccatccttaaaattctgttcctctagaaccattcccagtaccaaaatctgattaaaaaaaaaaaacaggcagaggaaggtggaaggactagatctttctccagtgctggatgcttcctgccctggaacatcagactccaagttcttcagcttttggactcttggacttacaacagtaatttgccaggggctctttggcacttggccacagactgcaggctgcactatcagcttccctatttttgaggttttgggactcagactggcttcctgactcctcagcttgcagatgcctattgtgggacttggtatcttgtgattgtgtgagtcaactctcctaataaactccccttcatatattcatctatcctattagttctgtacctttagagaacactgactaatgccgtggggttaagccaatcgtctagtaggttcataaaatgctaaaagcagatataaacttaaagacgatccagctcatctcttcattttacagatgtaaaaacagaagtagaaatagaattggaaccccagtttcttgaaacccagtgtttgcataataccatgctaatttcattctaatttgtgttttatttaataatcaggaaacagttcaaatagaggcccagggctctgaaacattgcccaaggtctatggcttttgcaaagcaagtactgtttctgctactttacctagttgctcttggcctatgtttggggtgcatctaaagaactgtttgctgattattaaataaaacacaaattagaatgaaattagcatggtgttataaaaacacagggtttcaagaaactggggttccagttctatttctacctctaggatacagggtaagtcacttcctttctcagattctgtttctttgtatgtcaaagggctggattagataaacttgacttcccctcttggccctcatgtatcattctataaatatgttatcatttctaatagactgtttgatgtaatcttttgtctaatggcccctgcttttcacaataaatgaaacaaaggtcacaagacttttattcatttgcaaccctgattaactaacagttaatgtgtaactggagtgccacatagaaacagaaaggagaaggggaatggattgggttggagaaggtgaagtctgacctatcctctacaagaggtacagggtttatccaggaagacaggagtgccatgaggagtaaactccagcaggggctggagtcatggccacacacagggccttacaggatccaggctgcccagagcagagtttggatgggggctgggaggctgggggagctagctgaggagatggttgtcatgccaggccacgagtgtggatgagtgctggccaggggaggtataggagattgatggggctgtggcaagcagggcagatacccttccaggaacctgtttcattaaacacagaatacagtcctgagggctcggtctcaatacagtcctgagggctcggtctcaggaaaacatgttcttaagttttacatccttcttctgttttgattaggtgtttcctgattataaaataaattcctagaactgttaatggtaacaacacaaagcactatagacccatacgaggatcatattgaaaccaatgacatttaagaataaaagatctgatgaatatgaacacttccctggttcctaggaggataacagttgagttttgctcaggtaatctgccttctcttccttcttctctgctttrtatctcagtttctatattttgtcttacattaataggatttgttctcattaccctgatgattttatggtaaactacctcaaattctttttggaagaagatgggatataaattatttttaaagtttatctgaatagatgttcttcaatatcacacaataaataatgacaatgtaactttgtgcatatagcactttaagagattgatcataaacacaatcctattaatcttaattcaagttaataatgcttgcatttgtatggcattttaggtattataaagttttttttaattgtggtaagatatgcataaaatttactatttaaacctttttgaagtgtatagttcagtagtgttaagtacattcacaatgttgtgtaaccatcaccactagccatttccagactttttcatcatcccaaactgaatctctgtacctattaaacatgacctcattctccacctccccacagctcctgggaacctctattctactttctgtatgaattttcctattctaggtgtctcatataagtggaatcatacaatattcatcctttggtgtctggcttatttcacgtagcgtaatgctttcaaggttcattcatgttgtagcatttatcagaatttgattcatttttaaggctgaatatcttccattttatgtgtctaccacattttgcttatccattcttctgttgatgaacacctgggttgttttcaccttttggctattgtgaataatgctgctatgaacactgatgtgcaagtacctgtctgagtctctgctttcaattttgggcatatacctagaagtgggattgctggatcataggatcattctatttttaacttttttgaggaattgccataccacccgctacagcagccgcatcttttatattgccaacagtgcacaaaggctctgatttctccactttctggtcaacatttagattatcattctttttttaaaaaaacgtaatagctaacccaatgggcatgaagtaaggttgtttttgttttttgtttttaatgtgtgcgttatcttacttgatccattaaatccctaacaagaactcctctagggcagatgtcctgtcttattcatccttggccccagtgtcttgcaagcaagtgaattctcaataagtgttaattgaatggatggttgatagatttataggatgcatgccaattctgtggacgagagtaggtactaattgttattttcatttcacagaagagcaagtcagggctccgagcactaagtgacttggctgaggtcaaactgcctgcaagttttatctaatagtgacagaggaaccaatgtgtcgagcatgaatgtcagtccattgaaacagtgcccacttttctgactctgctccttaagagacagggcctgtacagcaaggacacagagaagcaggttacagaaaaagggctggctcatccgtgtatgcctggcatttgaggaatgtggctgaaatctcaacactctggttcagaagcacatctgcaatcaaatataacaagacatggtatgagagatgtctggcataccaaggagattcctagaatacagcggataggaaaacctcattacttcaattcccaagaaagagtactactggtagtaatcccaacaggagtatccaagtaactcggtaatcttcagtaaagaaaagaaattgtgaaacaattatagtcagtcctccatctctgtaggttccacatctgtggattcaactcacctcatattgaaaatattaataaataaataaataataacaatataacaattaaaataatgcaaattttaaaagcataacaactatttacatagtatttatattgtattaggtattataagtaatccagagattatttaaaacatatgggagagtgtgcataggttatatgcaaatactacaccattttacataagagacttgggcatctgtggactttgttatctgcaagggtcctggaaccaattccccatggatactgagggtcaactgtaccaagttgaaaacaaaacaaaaggaaatctattgcaaaaaggaaattcccaaagataaaaagcatgtctatgaaatagtcaaagagccgaaaatgttgggaagacccacactgctttccctgccctgtgcccctttttgcagatctatttgtgtctttatctaccagcagatattctattattctaatagattcctgtttttcccaagagggtttacttatttattaaatatgatgcaaacatctctctcagagatgttgctctctcttcctaggattccttagccctaaatctgcagagccaattaggtattaatattgggctttacaactttggaccatctgaccaccaagactgattcattaaatgtatatggtttcagatcacattaatttatcatagactttagaattggctttttagaagtactgctataaggaaaatctcagcatagcaagttttatctaatagtctacttgtattaaagagtactcaatgtaaaccctaggaagacttttaactgccttttggaaattggttgagtgggatttgaaccgtgtactctctgtaaagcaggaaattatcacttagtaattactaagtatttaaaaatgggaaatagaaaattacatttcagacctggtgcagtggctcatacctgtaatcctaacactttggcaggtggaggcaggtggatcgcttgagcccaggagttcaagaccagcctgggcaacatagtgagcaactccatttctactaaaaataaaaaaaattatttgggcgtgatggggtgcacctgtagtccccactactcaggaggctgagacaggaagattgcttgagcctagaaggtcaagcctgagtgagcagtgaccggccattgtattccagcctgagcaacacagcgagaccctgtctcaaaaaaaatgtatatttttaaaaaaagaaaattacattttagttgttccataaatatcagtacaaccaaacctaagtgcaaaattcccaacacaaatgatcgcctctgggccagccatgtagcccccatcttgctgtcaataatcatttccaggggctgtaattgtcttccttccccctgtaccaccccatcacaggacacaaattgttttgcttagtttagatagctgtgactaaactaagtgccaattgtcttttaaaatatgtgttaatcagcactcaagattgttcctacaaaaatgtcactccctcactcaatttgcatgtgccctcctgagtaggagagaaagagctgagttagaggcagccctctgggacctgcacagaaccctgtatgcttccgggagtgtggagtgtgtgtctgatctgctgctgggaaaaggagaagaaatgctgagacactcactgccaggggctggtatcaggccattttcacaggggctgttggagggttgacagcacagctctactggaccagggagggtcccagccagcagggcctgcccctccgaaactgtccctgtccctgtccctgagaggccccactgagtgtcagatggcacataagagatttccttatgcgttggtgtgaaggagatgatcagttccaggaggcccctcccccatgcagaagagaagaaaatggaagaaaccgggttctcagagtggcctgcgggtgagtgccgccttgtgctgtcagttcccttcaccttccagttctgggtgtacctagtgtggtttcatcaaactgctgaggccctggaattgagggaggatgctgaagggtgccaggccatagaagcagtagcaggagctgcagcaaagagctagtgtgtctccagcgtcagcttttgggccttggtggcatcaaaggagacgtacacagggccactgtactacggatgggattcttggaacaaaagtttgaataattgatgagtgtggaagtgctatgcaaaaattcaattcaacctgcagttaccaggcattcattctgtgacaggcattattgtgagggtggcaaggagacggggagtctctgagagactcagagaagagcagggcatggtgtccacccacaagagatctgaagactttcaaagtagttgggaaaacagacatacaacttttttcccctccccacagctagttgaggcaaaagacatataacttatacagtgacaaaatactactgactgttactgacacataacagcctgggctgggtcactggtgagaaaaaggaggattcttgcttttggggcattcaagtcctgtccattaaccatttcccaatcccatatttatacatcccattttagacatattaagctgaagattgatgtgacatacccaaagacacttaaggttgaagctgagaatctgggctagaaatataaatcaggatgggctgggagcggtggttcacgcctgtagtcccagcactttgggaggccgaggcgggcggatcacttgaagtcaggagttcaagacctgcctggccaacatggtgaaaccccatctccaccaaaaatataaaaaattagccaggtgtggtggtgcatgactgtaatcccagctactcgggaggctgaggcaggagagtcacttgaacccgggaggcagaggttacagtgaaaggagatcgtgccactgcactccagcctgggtgacagagcgatacttcgtttcaaaaaaagaaaaaaaaaaaaaagaaagaaatgtaagtcaagattaaagacaatgggtgagatcagcaaggagcatgtgtgcggagaagagaacaccaaggaaggctgcgtgtggtgggaggtggccggggggcagagaaagaggcggcggagccaaggagatagggcatcgtctgaatggtgatgctgtatcaacagatgtgaaattcccagaggtgtgaaacacagcagatcctttacagcacgatgacaggacacagcatgagcctacctctgccaggtgagaggagctttctgcaacctgtgatgggctcaaggatgctgaccattcatccgcccattgggatagcccaggctctgagctcagcactccacccgtcactgcgattgcactaatcctcacccacccttgcaggcaggtattactgtgggcacagagaagtttgctaacttgccagagatcctgtgtaggaagccaggtcaggaaacaaccagagtctctctaacagcccaggccttgaatgaacaccggcctgcttcagaatacatggcccgtgatgtgtttgaattcacagattcactggacaggttccctatagggcctgtgaggaaatctggtctaacagaatccagaaagacaaatttcgctaaacaggtcaagcctgatactgctgctacacttcagctgtgttaagccactcggttatcagacctgcttctcctttcatgattttagtaacacaggcctcttccttgggcccctgttgctcccaccatctcccaggttctcttgtactcagggtttagtctcccctccccactactaatgatgcatgtgccttactctctgatcatctctcctaaatctgctactcctctgctctttctgtgccttatctatccctgccgagtctaacatgcagattttggtcattccaaagtcatgtatagatctaatcacagggctctctgcttaccagctgctacttggataaggaaagcatgccaacacggtcctccttcttcatgctggccaagtcagcatcattattattacctaagtttatttctaacacatctcaatatcttcatgcactccctcttgataaaagtaactgagcatagcaccatcaataccatcaaatctgtcattctcttcccctctctctgggtgggacaggaagccaggctgctctaggaaatcttccctaacaagcaaaggggacttgcctgtcctctcgcatgtgtgatctgagcttgtgtggatcccagagtgggcattctggactacttgaccttgcctatctctccttcacaccctctcatctctccctcctaccaccaaaaaacttgcatcgtatttccaatctccagacatacttttgaaaccatttatctatctggtgtgtttatctgtatctagtatgatgtgaatatgtgatttgtatgtgtgtctaccactgttttggtcagtttgtatttctcgtgggtacagttctatgtgctcatgtatgtggaacatatgtatactgacacatggacctagctccaaatgatctgaaaggaatataattgtaattgaatatttgcacagatatacaacatacacatgtgatggctgggggaaatgcatgtgggatttcagtcagcattttattagagaaggtatgtcattagtgctgtattaacaatgaatcagcttatttgtgggtcactgtcaatgactcctttgcaaatcacacatgtaaatatttctgtctgtggtctgatgaacatgcagtgccacagtctgggagatgctgagccatgccctgtgtaggcagcatatgaaaagaactgcatgatttaaaagatgctgaccagcttaaggaaagcaatttaaaaacttcctaaaaatctagtttgaatgaacaacagttttcattttgtgtgtgtgttttttcttttagagatggggtcttgctatgttggccacgctggtctctaactcctgggatcaagcaatcctcctgcggctcagcctcccaaagtgatgggattacaggtgtgagccaccgtgtctgctggccccactgttttaaaccctgattcgacaatcatacatttaactcattacctgtcttgttccttttacgacaaactcaaagcttttattttactaaagtatttgggttaatcttttgcttttctgtcatgttctgaaatatgtacaataacagaatcgctcaaaatattatctccgttaaatgttttgtggctttagggagaggtctaacaacatgcgggaaacaagaaatcaagcgcatccaggattcatttataatctctctcgttgagtagaagtccgcatctctcgatattgtctggttacctgcatgaagtattctaaaggaggaaaatagctcaaagaggacattcatgtgcactctggcttccagttggccatttgagtaagtgatcgcaattaactgacgagcggcagggaaacacttcctggaattctcatctacagacaagaacaaactggggcggggcccatcaccttcacctacgcgccgggagggtggcggctggcgggcggggccgggctcgggccgtgacgccgagagtgcggggcgcgcggctgggagcctcgcgcccccgcccgggcccgcccccatcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtaaagtcactgggaagctggcctggggcggggtttccccctcttctcgtattttagaaacggacagcggcagtgcagccctagtttgctgtaagtttccttactttgttactgaggcccccagagctccacgcataagtggtgtgaccagaaaccttttaacaagacccgcctgagcctgcgttagagctcccgctcggaaagtaaaagaccatcctaatccgcggcgctgcggaaccggtgtcccgtgtgggaggaaccgcggcgttccctgggcgtagggcccgcgaggccagcacagtccgcctcttggcggagcgccctgggccggtggttccgcgcggagttagtctgtggtcagttacgtggtgaaaacacggctgtgccgcggccgcatctttccgcggccgaggcctctctgggtgggagtgttggcttcctttccggatcgctaaatggggaaagttctggccgctcggcgggatacgtctccaggccacggatggttcgttctccgtgccgcggccccgagctgggctccctgggtctccagcgcgggctcccggcattgggggctgcgggccggcccctccgccccgcccccgccccgccgcgcctcctcggccgagcggctcgcggtctccggcgcgggaggctccgagtctgcccactccgggccgagcgaggtctctggaggagaagagtggcgaggaggtgagggcacgccggccctcgcccggcgggtggcgccaggacttcaggtgggaacgcgcgcttgggccgggggcgcgtggctggcgtggacaccggatcggggcccgccgccctggcccggaccgcgcacggcccagcgccgggaagtcgggaagccggggaggcctctcccaccgcgggccccggcagcccgccctctgaaagcgcggcggagaaggaggctcgtcccctccccggaacgcctttgttccctccggcctgcccgcgcgggtggccagcggctgggacccaggccgggccgccgcccaggtgcggcaggtaggctcgggggccgggcagctccggttggggcggcttcccggggcctgcgggtccccgtccctgaggagctccggctcctcggtggcgggacaggcccgtgcgcgggagccgcgaggcgaacgccgcgcccaccaattcggttgccggccgggggccccaggcttgcggccacccgcctccggctggagggctgaattcgagtcgaaagcccgtgtcgggctggaaagaagaaaccgccaacctgagaacgctttcggcgagttactggcgggggaaatggggacagggaagtgggcaggcggggagactgcagccgcagatctccctggcggggaggtcgtggccactctttcctttgactctgcctcatttcattttgaatcctgatgtgacagaggcaattgcttgcttggataccatataggtaaaagtaacagttttcaactcgactcttgactacaccctgtacattcttggccggtgttggttttcttaggttatggatcatgttaaaggtacaccgatgtggtaaccgcacagtggccgatggtggcctgaggctcatatttatggtaattatctgatgaaagtacatccatcagaattggatttgtgcgtctgtgcctttattttgggaaaccttgcctgttccctgtgggggatgggagaggaatgtgaaaagccgaagttgacccagaaaaggatgattgaaggtagttgtattaagtggtggcaccgaaatgattccaccctgaactttctgaaagggtgattagtgatcagcagcagacgttataactttctcaaaataaatttatggtagattttctatctggtcacaagtgaggaggtgaaagctgctttttggggccaactctttgcttttaaagcaagctaaacgcaataccagaaaggtttccattctgtacttaacctgcttgtccttctcactcttccttatcctcccgcacacgctctgagcattgactgagcactctgaggaggaggctgactcaggctgacccttcccggccctgcaaggctctaaggtagaaccagtgttatcacaggaaaggcccaagccaaagctcagagcagctgttcctgagaaagtgggagatgaggatgagtaggaggtagagatgcttataactgctctgcccagagaaaactcagaaggtgcagaagagttttcaaaataaagtgcaggccccatcaagtaaaaaatgaaacattgtatttcattaaaatggtgatcagttttctcttttcataaaagacattcaaatggtgagattgtaaaaaaaaaaaaaaagaaaaagaaaactttctaattctcaaaaatagaacagcttgaataataactcatgggttttgaaatgggtcatcttttaaaatgggtcactttggctagaatcattgcacttggtgactttcacattgtaaagggtccagttctttctgaggcccaattgcactagaatctgcatttcagaacacaggaggtatcaggaagaaactgggagaaattcagagggaaattgtctcttctcagagtaacaaaatgtcccctattcagggggaattttatatatgctgaagtaaatagatctcagctttgaatttttataatacattatgccttttctgaaatatttccatagccattattttaatgcattgttagaataaccttgtaaggagaggaattcattgtatctgtgttccagaaactgaggcacagtaaattacaagagctctgccctttgatatcgaatctctgtgagcgaagatgtaaccagaacagtgtaaatctagaattactttccttacggtatgcaatatctaattattatgtattagtttacatatatataggggatgtaagaatctttatatttaaaggataagaaacttgatcaggtgagatacaagatttgaataaaaaagcgattttttagaaacattttaattctacaaattcagttgctggctttgatatgtaacttattcagatttctcttccatagaaggctttaacactagaagccagttctctacaaaagagaatgttctaccaagtgtgtaggcaacaaagcccaaaagttcaagttcaaaatactgttctacagcctaagatccacctaatatttcagatttgactcttttgctcctttcctataacttcctataactttttcatagtgctctaagcaaagtaagttcaaggatggactcacctcaagtttccttctcttactttagaggaccatataatcttatacctgtgtcatcctaattgaaatgtattttaagtgcttgtgggaacaagaataacggaagaccgttattccattaatggaataatggggaacatgagaaggaccatattcagtcaattagggatgatacttctgcctcaacagtatttgcgatgtgttaaatggcccttagccatcagatcagtatttttaaaaactcctacctaattaatgttttttgagaagaagcatattatgagtatagctcagtattctaaaaagaaaaaaacctgaaaaaaaaatcagccatccattaactaacccatcctggtaaagctacacaaacagattctagagaaaggaaatttgcacagatggaacatctaatctggactgacattgtcaacaagttatctcaaatgatcctgagaaaacactggtacatggtttagagacaagtcgagctcatgtgactagtaaatggagaggcacagtatacatctacttttgttggcatttaaacactctcggcttttttactctctttcaccaccatcaggtccagattccagcttgcactggaatatttattgaccctttgatagaagagctacacctgaaacatctctgaagtctttttagcatcctatcctgcccatggcctactacacagtatgtgataagttaatgtttgttgaattagttaaatatacgtattaacctactttcagggctgcccgctgtaatgcctagaatagggcaggcacttaataaatggtagttaacttagactaaatgttgatccaccaagacagaaacatgttacatatacctcttgttttacaccatcttctactttttgtacctctgtgttataaaccctctatcaagtgttgcttctaaagacaatgtccagaatgggacgtaggaactgccactgggcaacaggcagacactgggttatatcgtcatcctgtttctgaatcctggtttttcttattattattcaaccacagctaaactttctgatctccttttttccgttttttccctttaccctaacttctagccaaactaagtgatttgacatttccccactcaagccacaactttttctcttatgtgcttaaaaaaaattcctgcgtagtctctcttggaatgtcttattccttgctccctccacttcaccctttttttttttttttttttttttttttgagacggagtctcgctctgttgcccaggctggagtgcaatggtgccatctcggctcaccgcaacctccgcctcctgggttcaagcgattctcctgcttcagcctcccgagtagctgggattacaggcatgctccaccacacccagctaatttttgtgtttttagtagagatggggtttcaccatgttagccaggatggtcttgatctcccgacctcctgatccgcccgcctcggcctcccaaagtgctgggattacaggcatgagccaccgcacccggcccacttcaccctttaagccagttgaaatgctccttgccctactcctcccttctccttttctttctcccatccaagtactaaccaggcccaaccctgcttagcttctgagatcagccaggatcaggtgcattcagcggggtatggctgtagacttctctttctgagctgtgtcttcctcctttcctccccaaacccacatttgaattctgttctagctcctgctcatttgccacctctcccacaaagccttccccagtttccatcttctccctgcttccctcatctcagaggaaagctcttcattcacagagcacctggtttggggtccatagtttgttgtccctcagtatccttggggaattagtcccaggacaccacccccccgcccctgatatccatgcatgctcaagtcccttatataaaatggtacagcatttatattataacctatgcaatattcccatgtactctttttttttatttttatgtgtttagagatgggtctcactctgttgtccaggctagagtgcagaggcatgtagccttgagctcctgagtcaaatgatcctcctgcctccgcctcccaagtagttgggattacaagtatgagctaccacacctggcccatgtactttaaatcatctctagattacttataataactaatgcaatataaatgctatgtaaacaattgttacacggtattgtttagtgcataatgacaagaaaaaaatgtgcatgttcagtacagacacgaccataaatttttttttcaaatgtttttgatctgtagttggttgaatctgaggatgcggaacccatgaacgtacacgaccaactgcatatgggtttctaataacagatttgtggatgaagcccacccaacataatgcaacatttcaaatgtatcttagtcagtttttctggggcaaagccagcctaacaaatctcaagaatgtttgaaaaattctagcttgagtgaacgttgttcttctagtgactcaaataaagcagtcattgtgtctgaggagtcctagtggggtggcaggggtggggctaggagtagtggctgtttgtagcatgttttatatcacattaaagggctgggtatgcattttaggcaataattcttactcttattgataggagaacttgtattttttattcatctaccttatgatggataactggtttacatctcttcatcaggtttacttcttacgtgtcattttatgagctgactttgaatatatcttcagattttccctgcctttacacatgaaaacggttttgatacagctttttcattagagaatggcagcttttccaggccagggtgtctgtgtctgactcctcgcctttcattttacccaatacttgcttaaaacatcctccctgagtccggtacttttttgcctcctctccttccttccaccccacctctttttgtcaccctcctgcgactttggatctccatccttggagtccctgaatcttttttgtggttgaaagactacacccaaaggacacagactgatgaggtcacttctgcccactgtctagtactagtgagaccaagaagaagaaggagggaaaactgaaatggaaggtttgaaaaagagtgtgttagtgaaggaagtaagaacagtgctaacagaatgcagcaaaacagaaatgacttcacacttctggcagtgaagcaaattctcatccatcttgggttgcttctcttgaccctgcccacctcctcccctgccctcccctcccgatgagaactgcaggaacacctgtgcccatgccaaggaaaaagggcaggtgaggaacacagggatggggctgggactcacaagctgctctaagctgccacagggtctggaatttgttgacattacatggttaactcggtatctcgatgcctcagtatcttctgcaaaatgtggagggagatcctttcttcctcaaaggttgttgtaaggcttaaagagctaccacattcgtaaggcatttggaacagggcctggtatatagtagacatacccatggtagtaactgttgctagactgggtaaaaggagaagtttcttaagtaggcaagaaaaaaactgacaacagttatatttaaaagagcaagcaaccgtgtcagcccaaacaagtgtgttgcaagaatgagcacagagggccaagctcagaaaagcgagtgtttgacctctctgagacctcctttatatgtcagcttttttatttgtttcaaattttgcataatcaaactggttactgggaattattgagttcatataacttccctaaaatctaagaataatctataatcccatgccaccagtcccgttaataaagacttagggtctgtctttacccatttgttcatttgaaattccccgtctttacttcccccataaccaggaaacagatctacacccatgtttaacttataaagagatataagtgagtttacataggtggagatcttgtacctggattcacattgtaggttttattacccagctttcccctctatcccaaagccatgattgccatagtggaatttaaagtctttggactaacactgaatcaagaactaactctacaaatgtattctctgcaggaggataagaattccaaatggcttctaattgttgcccatggcttgaaataaagttccatatagctaaagccccagcacaaaaacacttgaagacagccattaggtagaatttcttttcttttttagaggtcttatattggaaatgtaacagttgcaaagatatctaatgtttcaccttaaaatgtgagttataaattcacatttcacattgcctccttcctccttgagcaaacagactaggcaattagtaccaaatagtaactagttatatttcttaacaccgattattgtaagtaatttattaagaaaaaatctaggaagatcaaattatagcttttccagtaaatctggggctttttattcctgatctctctcaacaaggcagtttggcttctgaagattggtcctagctatacttaacaggaaacagatgacgagaagaagccaggaaaaaatacttggaatatagaacaaaatgcagcataaagatggtacagaagattttatctttctttcctttagttatgtgtggacaggaactaaaaactctcccacgtgggactttattaagtaataaaagtttaaatgtaaaagatataaaggaatgaggatataaaggaaatttttttaaaaactgtgactcaccggaggagccttatatagtctactttctaagcatatcacttttaaagggatcattatattttcatgatgcatggggatattccaagtattaaattgattttttaaatgaagaaaattatcagttcagtcttgttttctatgtaggtttcactacagtattttatttcccccgcaaggaaaaaaccagagctagaatggaatgattaaatttcttagttttcttctaatctgttagtctttccattaaattatactgccttcttatatagaatttctgggtttgttcttgttttggcaataattgaagtaagagaggatgattttatggtagaggtttgattccattctagattggtgtttttcagctatgtagaacacaatccattcatggttcagacaaccgttttaggaggttttcatgtccagcattaaaaaaaaaaaaaaaagaatagaattgggcattcatatatatatatatatatgaatatttattaataaaagtttaaaagatataaaggaatgaggaatgcatatatattatatatatatataccaaattaaagtatcataatactaatacaaggattagtatcgttttatgatactttattatatacactaagggttagtcttgttttatgatactttattatatacactaagggttagtcttgttttatgatactttattatatacactaagggttagtcttgttttatgatactttaggttggtatacatacatatactaagaatgcagacatgtccatggaagttggcaatattcagcccccagcaggccccagtcagcaggacagggattaggggagtcaggtgaggcagggctgtataagtgcagggttggagcctgtcttggtttaccgttttgacattttgttcactgtggatttttttcagtaactttgattttttaaaaatattgcatcaaaatattatactgactacggagtttttggtacccccttaaattgtgcacctaaaataagtggctcccttgtctccccctagtcccggcccgatcagtatgttttatagagggaatggtgagtgttggggaactagggagcccatgaggaggcggcccagaaggggaggaggagctgatggtgtgtctgatgtctcctcctttctctaggaagcagacaggaggtgaagtcttcagggtgggggggacagagcctgggagggggagatttagcatggccgctgaagagactgggaaagggagaaggttcgggacaagttcaggaacagtcacgtagcactgaaaactgctcaaagctagatagtgccatttgtggtgacgctgcctgcctggtaagtcccatttccccagcagccctggaggtgtcataggaacaggaagatgggagggcgctggggtctggggttgttggggtgggagggcaaaggtgtccaatgattctgcatctgaaacgggggaggtgtgtgaggaagaaaggtcaggagactgctgggcagggtggggtggcagaaggttctcgatgaatatttagaagttgcagctgaggagtgagtgtactatagagtgagtatcctggaatttgaggtctcagaagaaatgcagttctcagtgaagccatgtaaacaacttcctggctgataaggtgtcttgagtgttgggagatcacatgatcaaaatggtatacacaccataaggtgtccttagacttgagtgtggtgtaagtctactgaataaaatgcagaaatacagttcactgttgcttttcttcctggaaattgccctccccaacctcaaaccagcccccaagtggggcagggtccatctttagaccctcctgtagcacccagcacaaccctaactatatggtcaatgtctctcttccccacttagagctccaagaccagggccttgtttgtcctgcttacccactctacccatttgttaaccccatcttaattttctgatgaatgagcccttttttcattgactcctcctttctctccttctccggagtttatttttcctccaggcccattgctgtctctccacctagagagcttatccacattcatgaaattagtcatcttcatgctcagagtacccacctggatctctccagtcctgtctaactcgtcttagattattaccccctggacatctgtaccttcttgtctctccatcgcctcgaactcaatgcgagtctaaaatcaaatactccttcactcctaactcaggaaaccagttttccctcccttgttggtaatgcttgaaattagctcttacttctcttcttcctcctttactcgccatcccaggtcattcatcaggtcctgctaggtctttgattttcttgaaagggccttctttatgccttccttccgtccccatttccaccaccctcgactaggccttcctcacctcatccggcatcagtgtgagcccttgagaaaccagcgtcctgatcttcaggcattctgcatttcaccccataccaccattagccagtttaatccctcttgctcaaacttaataaatactgagcaagggagttactataacaaacaaaaccagaaatttctatgacttcctgctgctttctgtacccccctaagactcctctacctgattttcaaggttctccataagcaggttcccacctctctgctttcaaatcttctatctgccatacacagttcttgtctaaaacaaagattgttcctactcctgcagccacctaaatcctagtcgtcctcaggccctcctaaaatcctgactaatccaacccccaccgatttctctactagtcccagagacttccctcttgtgcctggggttggtgtcatgcagacacactgtaccttaccaggatttgcccattgttgtctgtgggaactatgctttcatgtgggaactacgagtcttgtcacaaatagagtgtaaatgctttgagattggagactgtaaaatacttcttcatgatctcccactgtgtctggtataagaacccgcagagtaaatactcatatacttgtaggattaattgaaacaactggagactgaggttgtttaacttgtacttagaagtgtggacctccccatcttgattaaaacttcaaaacggatagcaggtttcacatattatctcagcatcacaaaagtagactcaacaaagaaatgagttgacagcaggggtaaggtttacaacaatcagggattattgcagggaaacttgtagcctttgggtgttctaactagttttttcccaaaaagtttaaagagctctcttgtgaaagaatattcttatgagtaactgaggggcacggctcctagactgaaaagtatttgggatctgtcacctcttttctgatgttcctacttctattctttattcttctgactacctctattagaaaagataatactaagaatacctgtcccttcttctcagtccaaatagaagcaaacccaggttgtatctgagatatctgcatattttcttctaagcaattctttgtcctcttctctcccatgctttttctatttcctattttcagcaggctctgaagtcatttataatttttactgcccctcggtgacattacatggatattcatccctgatttgcagattaaagcaccgaatcagagtgaggtgagggttgcccaaggttacacaataaatctggccccaaacaggggtaacccttgagtttctagtctgttgattggccactgacccgtgctgcaggcacacaaaggaagctgcacccacagcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtatgtgcgtggtctccatccgcaaagccggagctgggcgcaacagtgttgacttgtaattgatcaatttagatcgggcgcaggccgggggagggcagtgcttttgatttaggctgggaaaggcctcctagtgactatgttcaatttggaggaattcagatgttcttttgttatacaagtgaagctgtgtaatacaaatgaggagttttacttttcctaaatcttccccttatcattcaagtattgaggagttttacctttcctaaatcttccccttatcattccagtattatcagtgagatctggttgtgatttatgtaaatggtggctaaaaaattcaaactactgagggggagaattctcattttacagcttcacatgctgtgctgaactaaataagtagcgtgggatgttggctttgtgacaggtcttttgtcatttttcagaaagcattttgacttgttgatgtcaatttggaacagctgaaaaaatacaggaaaataagataaatacgtacatgttgagggtggggacaaaatgaaggttctgaaccagctgccggcttacagtagccatataagcaacagcagcaatgcaccaacctggtgagtaataggcctgattcactggagagatactagcacctttaatgagtcagatagatgcacaatgggtgtgggagcagttggacttgtgggcacaaagtctagcaagaagctcagacttgcaaacaactgtaggacgtgcaaagcaagctggcattggagcttgccgggcacagctgctcaggaataggcagctggttttccctttgatccctgagattccaaaggttactttcctctttgttcccttcccagggtcaattagagtagaaactgcagatgcttttcagttgagaattttcctagaattctcaaaaatgtgtatgctggcttaaaatctgccatcaagaattctgttaccttgctttaagcctccagttccttccagatgtatggtggaggaggccagagggcccttgttttggggcttcagaggatggttgttatctggatgagcactgtggaaagactgagagagcaactgagagaaagtgggcccctgaatgaaagtgatttcgcaaattttaggcagatgccaccatcagaaactgatattttctgacgtctttctcaccttcctctagagcattcagtccagaaatgaccagcctgtccaaagggggaaattactgatattgatctgttccttagagcagtgtttcagtcttttttttttttttgagatggaatctcattctgtcacccaggctggagtgcagtggcacgatctcggctcattgcaacctccaccttcctgattcaagtgattctcctgcctcagcctcccaagaagctggaattacaggtgtgcaccaccacacccggctaatttttgaattttttatagagatggggtttcaccatgttgccaggctggtctcaaactcctgacctcaagtgatcctcctgcctcggcctcccaaagcgctaggattacaggcgtgagccaccatggccggccttcagcctttgtgatattaaagcacagcaacacatttcccattacacccctgaacacacacacacagaaaacccaaaagtttcacaaaatgattcttgctcttactactctcagtacactctgtatttaaaaaaaaaaatgctggttgtggcttcctaagtggtgcgtgcagttttcaaatcaatgcccttggcgataaagtgtgccctatactgattatctctggacaaagtctgaatggggcttggctctaatctctagtcctcattggacattttacatacctggcctttgcctccaccctgatgtggagtgatcatgggggtgggaaatatagctggatccgaaagctctgaagtggggatggaggtgtcacagctgaggctaggcccattctgcagggcactcagtgtgtacagttggttttctatcaggggtcaaccggcggggggacttgagaacagatctctgggcacaaagcagggcctttgccctggggcttgctatgtggctcagcctacacggctctctccccgtcagtcctgtccaaagcccaggaaactaatgtaccacccccgaggaagagagcctacctttccatccaaggaagtgttttacctgtggtaagcacgggggacagaattcttgaggaaggagggtgctgcgtcccagtggtggaggaaaagagaggacctggtgtaagcagccatggcatggacctcatccgaggtggcacctggctagggtcctgacctccaatccttccccagtaaccatcactttgagtaaacagtggctccacccccggcatggttctttgcaccaacatttggggaatgcctaccaggggtcacacactgagctggatgctgagtgtagggtgtccacaacatcgtgcctaaaaagtctctgtatggggtataagaaggtgctggggcaatacagatgagatgagaagcatctttcagggaatgggttgatcccaattcaggcttcccagagaaggatgtctgtagacttcatattagcaagggaggaaggtagccaggccacaggactgctggtgtaaagaccagggcatatgaaatggcaagtgtgactgtgctttcagccaataatttggtattgtcaaatgatgggaccaaacagctggagaggcagatcctaaagggtcctgtgggccaggctggacttcatcttgtcactaactaatggagaggctctgaaggagttaaaagagctcagtttgtctcgtggttaaatccaagttttacaaaggtcacgctgactgtaaagtggaaggtgggctggccaggggatcatctagtctgggtgagaagtgatgataacatgaaggggtgaagagagatttagaagaagtgattcacaggattaaacatttaaataatggaagtggagaaaatggggggggcggttccagatttcaggcatagatgaaagaagtgcagttaggcacatgtaaagagaaacaggaacagcaggttttaggggagaagataacagaatgggtgagaaatgacacttgagtaccctagtgtgctaggtaatcatctgtctacttcccttcatttgtcatgtatattcccatttaatttgcataaagacttcgagttaaacggtcttaccccaatttgtcaaatttctgcgcatgatatggtacaagaaaccgtaagtggctaaggcggcattggtgttcaaattgcctgactacaaaggcagtgcttgttggctacattctgttgcttcccagtttagaacatgttacattgaggcgcctgctgcatttccaaataaaaaagtacagaaagaaggtggctgtataaatctggggctcacaaagtaattttgattactgagagtttgctttcaaggagcaaactgtgactccttgattatgaaccttaatttaaaaaaaaagaaaaaagaagtcttactcttattcctgccttgtctggggcaagccttaatggatttttactgctgtgaattttcttttcattgaagattttgccttgatctatgtatctgctttcatcctgaccatattcaagtcagtatattcatgaatgtacctgtttgtgaaatttgaacttaagtatacacgattatagccgtttgggaagcttttttttttttttttttaagagtaggagtagaaaaaggtctctgtactctgaatgggaagacagtgtaaagcaattttttcccttttcctgtcctcctttaaaaaaaataaacagccgtatgcctctgctaagtactaactacctcatcaccttttgtgcagacagggcaggttacatttggttttaaggaattaggaatatgtttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattatcatgagatgtgtatttaaactttttcatgaacattgcttatataatcattccttctgtcttaatgtactacatggtcttagccctgttcctataggattatcatgttctctgcattatagagccacctaagatgtactttttgttaaatgactcatgctggaatatctggatggggagatgttctttcctaatgtagtcatgtgccacaaaatgacgtttcggttaacgatggatcacatatatgatgatagtcccatgaaattgtaatggaactgccctatacaggtgtaccattttttatcttttatttcagatttttactgtaccttttgtatatttagatgtgtttagatacacaaatactttccattgtcttacaattgcctgcagtattcagtacagcaacatgctgtacaggtttctagcccaggagcaataggctctaccatatatctaggtgtctagtaggctattccatctaggttctcgtatgtataacctgggatgtttgcacatcgatgtggtcacctaaagatgcatttattggccaggcgccatggctcacgcctgtaatcccagcactttgggaggccgaggcaagtggaccacctgaggttaggagtttgagaccagcctggccaacatggtgaaaccccatctctactaaaaatacaaaaatcagccaggtgtggtggcacacaccagtaatcccaactactcgggaggctgaggcaggagaattgcttgaacctgggaaagggaggttgcaatgacctgagattgtgccactgctctccaacctggacgacagagcgagactgtctcaaaaaaaaaaaaaatgcatttctcagaacttatcctcattgttaagcaatgcatgactataatctgttgagagagggatgaaatcacctgtagttatagcgctttaagataccatttgaaaaggttacgttttccttttctttgacacggttagctgtctgaaatacagtcaattttaaccctaatctcttaatatcaggaatgcccttacacctactttggagtgtctggtgcttcgatatagttgcatgtaatgtgctctcatctgtttttacctgattcctgctcagttcttcacatggcatattgtgtaactcaatctatatttaaaacttgtaagcatccgaattatttgtttatggtagaactttttacttgcaagtcgtggtaggagtgtttgtagttggtactaaaatgtgatgacttggaagaattaattaatgacctatatttggggactttaattggatgctatagctgcaatgagaatagaaccagagaactcttgatatgcaaggttattcattctgtgataataatgagaggaatattcgatgtctctttgagtcagttttccttccgatcacttccgcattctgcagtgacacaatccttaatcatagctttcattacaatattcctttactccagacctcaaagactcctcactgcctccagcatcaaatctaaactcttctacctggttttcaacgccctacgtaaacttttcctccttcattccctatagcttggtttttttttttttatcactgccactattatctatcacaaatgtcaatcatgaccataccttgcttaagttggtttcccttgccaagagcactgtttttcctatacctgttgaaattttggaaatccaattctacctcctctcttcccttaagcatctcttccttcccttctccccaaatttatatttagtcacatatattatcgtactacctactaatcattccatgtgtttttttacgagctgtaagttctgaaggcaaccatgccttgtacagtgtccacttagggttctgaataattaatcatctccccaaaatctgaaagccttctatataccaagcaaatttgtttagttatgcagcaaaactcaaatctataaaatcaaaaaggaataaggaaatacagattaaacagttgcagcaaagactggtgatcttaaggtatttagtcaaagctggtggtagaacaaaaacagtagtcttacagattctacctcttgattaactcagtggctaattttgccttttctcaaagttcttttgcaagaacataaagatatttttgtttctttagttgagtgctgtaactttattcctttgtgtttctcataagtatgatttggcagtctgccatacgttttttgttttttttcttcctctttgagacagggttttgctctgtcacccaggctgcagtgcagctgtgtgatcacagcttagctcactgcagacttagcttcctgggctcaagcaatcttctcacctcagtctcctgagtaactgagactacaggtgcaccccaccacatcccgctaaatgttttaatttcttgtggagatggtgtcttcactatgttgctcaggctggtcttcaactcctgggctcgagcaatcctcctacctcagcctcccaaagtgttggaaagtgttgggattacagacctgagccaccacacctggcctgttataagttaatacaataattcatcaactaacttaaagaacactaagactcttacaaaagtaggtatgagttttagtaaaagtctcaaaagataaactgtcacttaaggaaaactagagaacatatcattgccaaatggtgtttttcagagattataccattcaacgcccacatgctgaattgggccattcattataactccaggaacatggcaatcagtaagagcccacatgtttctttgaatacaccgtaagtgaaagaatataaagtagtctagttaatattatgtttaatcaaggagcacattcctaaagatgtttgttcattcattctacagacatttttcagaggcctgctaagagtcaagcattatgatagacgccatggataaaagcttacaagtcaaccagcgtgggtataaataatgtgactagcactagaacaggtatcatgatggggattctgagtataaatatttttttaaaataaatttccccgtgttatttttggcttttacctccctaatttaggctttctaaatggcacagcatttctgaggatgcaaacacctttctacagagcaaaaacagcatttgtataaatttgtgtctttggggaaccaagagactttaaatgtgtttaaaccaataattcagtcaatatcaacattagcttacatgtaatattctcttgatagcccaattttttaaaacactgtattcttagaagtttggtttctaagatgtcactttaagctcttttgcttgttgcttttgtgggatccacaaattttgttctcaggtacataaatgaaggttagtatagaggataaatattatgattcttatctgggaaagacaggtgctgaggtgtaaaagagaggatcctcgccacccatgccccgcaccccctcgccccctgcacccacggatgtgcagtcttacctgcggggggaaaggtctccgagcctggcctgctgctccagctcagggttccccctttcatgatggctttcaaagatttcttcactctgaagtgaaagaaattttggtaagatttgatattgtagggacctcctaatctatatttttctctctcccaatttctgtgtttgattttggttttgagtctctcgataagcaaaatatccagtttctcatgccgctttctcaggttttccccagccactctggatccattatggtttgccctttttggcttcctttaggcacactaaaaactccttcccaaaagcaggtatcggccgggcgtggtggcaggcgcctgtaatcccagctactctggaggctgaggcaggagaattgctcgaacctgggaggcggaggttgcagtgagccaagatcacaccattgcactccagcctcagcaacagagcgagatgccatatccaaaaaaaaaaaaaaaagcaggtgtcctttccccttaatcatgaagggctattcatactttactgccccacccctattgattcataagaggacagtaaagcgatcactgcattcaacatctcctttttttttttcttgtaagaaatcaaggtctggaaaagttgcactcgccctgagaccagaaagtgctggaggcagagatgaagtaagcccagtgtaggctttcacagatgcgtgataacaagtctaactaaagaagtacctgggatactagttttgccaattcagctctaaaacaatatggcaatcttatattccaaatatatatatatatatttgtatttatagtagagatggggtttcaccatgttggctaggctggtcttgaactcctgacctcaaatgatccactgacctcagcctcctaaagtggaggaaacatatatatatgttttccttttaaaataggatgtcagtccaataagaatctaaattttagttccctctaatatatatatctgactagggaccagataatatttttcatgtgtcaatatataaaagttggccaggtgcagtggctcatgcctgtaatcccagcactttaggaggctgaggtcagtggatcatttgaggtcaggagttcaagaccagcctagccaacatggtgaaaccccatctctactaaaaatacaaaaattagccgggcatggtggcaggcacctgtaatccagctatttgggaggctgaggcaggagaatcacttgagcctgggaggcagaggttgcggtgagctgagattgcaccactgcactccagtctgggcgacacagtgagaccctgtctcaaaagaaaaaatatatatatatatatattttttattatattgtttattaaacaaataaaaataaaagatatctcatcagttacgatgtaaatgaaaaaattgtgtgtgtgtgtgtgtgtgtgtgttatgatgtacttcttgtgagttgtggtcaggctttgaaagccactatgtatgtgtgtgtgtgtgtacataaaagtaagtatcagtcccaggattcaaattcgaaccagtcccagtcaaattcaatctaattattttcaccacactaccaaaagtctttcttcacattttctatataaagttgaactaattaatacagcagtgaatgttacattgtatccttttgcagtttctcatctatgacattactatgcctgaattccccactggactttgaactcagtcttactcatctttggatccccagcgtgtaatacaggcccttcataaagagtgaccattattactaacaaaatttcctctcactgtgaaacctgctcccaattataaaatgaattgtgctctttcgaactccgttgatctattgtatgcagggtggatcatagagtcttatttcataataacctagtgatggaaaaataacaatgattcaggagtaggtaatggaccttgtcatcttttacactgaatgatgagatttccctaatttatagattttgtcatgcatgagatgccctcaggagcttgcagaaatgccttggcacgttgctctgctgacatgtgtcagatggctggtgtggaggtagagggagtctcctctgccaagcaagtctaatggaatataacactggtgccattgaggatgcaatgagaaggacccacagcagatccagagactgcattcataaaagctgcacagtataccatgttttattaaggtatagacagattagttgtgttctagcatagtggttttcaaagcctgaccacaactcacaagaagtacataacacacacacacacacacatacacacacacattttttcatttacatcgtaactgatgagatatcttttatttttatttgcttaattttttatttcttttttttttgagacgaaaggtgaattgtagccaaagtacttttaggaaattttaaaattacacattttgaaagctctaggaggaagagagcatattcaagtaaaacctttcttttattcaaatagtagactaaaaaattgaccatagactaactcagcaattgctgccatatttcttagtgagggattccttatgagctccattgaatgataaaaggatactcttccaaatcagagcaacaatcgtttcttgtgacactgcatcctttttcccttccttcaccctgaattgcccctagggtatacctaggagagggagggctggcaaccagctgctgttgtgaaagggatgtcattcatggcctgccctattgggaggccaatcaggcggaacagcccctctccccttatggtcattttatcctgaagaaaaagggtggcaaaaagatggcaaaaaagattgctgatcacagatcactgttacaaatacaacaattggctgggcatggtggctcacgcctgtaatcccagcacttcgggaggccgaggcgagtggatcacgaggtcaagagttcaagaccagcctgaccaacatggtgaaaacccgtctctactaaaaatacaaaaattagccgggcatagtggcgcatgtctgtagtcccagctactcaggaggctgaggcaggaaagtcacttgaacccggaggtggaggttgagtgaaccaagattgtgccactgccctccagcctgggcgacagagcaagattccgtctccaaaaaaaaaaaaggagggggtggcaatgagacagggaactgctctgggtccaactcccctcacatagccccaacccccatatccaccccacaaacctccacctccccacttccagcctctccagtttcaaagtgacgcttaccaacacgcaggctctccaggagcaccttgaaaggtaacttcttacatctttccaaaacacttataatctaattgttctttctcccctatattttgaagaaatgcatgctctcaaaattgaaaaaaacgcctagaggaattttgtaaaaaaattatatttttccagtttctccaaaggacatataaaccctttttaaacttagattttgaaaagtcccaatagctgattttcaatcgattattgaaattgttttttttttcttccctaaaggggagataccaacctttgaacaaaattaaattaacttttccccaaagttaaatgattttactttgtgattttaggaatgtgtagaaagtgatttcagttccaactcttttaaagcaagggtatctgggccaggcgtggtggctccctcctgtaatcctagcgctttgggaggccaaggtggggcagatcacctgtggtcaggagttcgagatcagcctggccaacatagagaaaccccatctctactaaaaacacaaaattagctgggtatagtggtgcgcgcctgtactcccagctactcgggaggctgaggcaggagaatcgcttgaacccgggagacggaggttgcaatgagctgagatcacgccactgcactccagcctgggcaacagagtgagtctctgtcaaaaaaaaaaaaaaaaacaaacaagcaaacaaacaaacaaaaacaagggtatctggtaatttaaggtgaaagtattattcactattataatcaattttcttaaaaacaggagctattaggcccaattctgaggagagaaaaaaaagcagatttcaagggcccgtgccaccttctttgtttaaagcatagagaatgataataaaatgttaaaggttcagcattttctggcattgtaaatttaattaattaattatgtaaattaattatggaaatgagaaataaagtgaaaaggtatgtcaagtaagaatcaataattatcaaaacgttctctaccaaatgggatgcaggggagaagggtgagaagaagggaaggaaataaaggcaaaggcatttgcccacagcctcagtccagggtgttctacatgacgcagccccagagtaaaaaatactagccacaggaatgagtggctctgtcttcctctccagaactgacgggcaaaagagggggaacctcaccttttttttttttttttttttggaaactcactgggttttgatatggagaacaggaagagaatctaccctagcagcacattcacagatggtttgtctgccctatttgctccatctccctggctcttcctagcacttcttttcctactttccattttcattggccgcaaaagccacttaaatattcctttggaaaactgggcagtctgtcccctttttaaaaccacaactatttccaggagagttaaagggctttcggactgcccatcattcatgcattgtggtgaactagctcagactgcctctacctttagtccagatcagctgccttgggagggcgattcctggaggaaaggatgaggagaggaaggttttaggacatcgtatggactgaagccccgttggaggggaagggcaggcttgaggaacaagcctcagtgttcctgaggctttgtggaaatgagaaatgaatagagaaagataagagactggatcctaaatgcaattttgcctatttcaaaattttcacagggtctttttttttttttttttttgagacaaggtcttgctctgtcacccaggctgaagggcagtggtgtgatcatagcttcctgaagcttgcagcctcgaactcctgagctcaagcgatcatcctgcttcagcctcccaaagcgctgggattacaggcatgagccaccacccccagcctcagggtctttttaatccctaagatcttaaatttcccagctactattgttagtaatgagttcaatttacttactggttaaattggcttttattattattattatttattttattttattttattttatttgagacagagtcttgtgctgtcgcccaggctgtggtacagtggtgcaatctcagctcactgcaagctctgcctccctggttcatgccattctcctgcctcagcctcccgagtagctgggactacaggcacccgccaccacgcccagctaattttttgtatttttagtagagacggggtttcaccatgttagccaggatggtctcgatctcctgacctcatcgtctggactaatactctaaacgctattggcaatagtttgtttacaggaaaaacatcttcttataaagctgactgcaaatgttttaataaatttgcaaatatgtaattctgtttaaaatatcaggaagtgagaaacatgttatgtgataactctttcccattcccgaaccaagaaaatgtaaaggcagtaagtgtgccaaggacactgaaaggaagctgcccgtacatctttgaatcttctcaggctgtttggtttcatctgattttaagctccatggataaatttcattgtaacaatttttatgtctgtaaatcttaacccataaataaaatcacaaatcagaaaagtactttattaggccagtctttgtccaagcaaatttggtcccaaagctagtttacaaataattgccacacagctacaaggccagtgggttgactatcgtagcatcaatggtgtgggcagggctgcagcctctggggcagcattagccccaactgacagagggtataggtgctcttaacaatctatgagaccccccacaacctggactcagctgtcataagcctttacttcttatgttcttcctaagtactttatcgggccaacaaattcatcccatgaggaatccaagatggaaacgtcaaaactatctttggtatcatgcttcctccccctaccttctctgccttgatcccctccttcattctacacattttctctgatagtcgtgttctagccactagggagaacgtttcagtcaatgggtatgatttctgctcacctctttttgccatagctattagtaagctctcaccactgatgtctcagctgactgtgacaactgccagcggctggtcagcctgcctgccttcatctaacctgctctttactgtctaccagagtcagcttcgtaatacacaggtgccctcctcctcctgtcaacattcctcaaccaaagcctcagtaaactgtctctcatctaccttcccagcattcttgagccattcccaggatagcctaggccctttagacctctgagatgttatacccttcctcattctggaatgcccttcagtgtcttacccacctttcagagttctatttattctttttttttttttagatggagtctcactctgtcacccaggctggagagcagtggcaccatcttggctcactgcaccctctgcctcccaggttcaagtgattctcctgcctcagcctcctgagtagctgggattacaggtgcccgccaccatgcccagctaatttttgtatttttagtagagacgaggtttcaccatgttggtcagtctggtcttgaactcctgaactcaggtgatccacccacctcagcctcccaaagtgctgggattacaggtgtgagccaccacgaccagccttatttattctttagagttgaattcaaatgccacctcctttgaaagccatccttgatgtccttgtgaggaattactttctctaccacattatatattccttttactgtagaaacgtcattctgctttatattataaattattagaaatatgttgtttcccccatgaaagtttcaagtttcctgagtttaggcctgatgatacaatcattttcatatgactcacagcaattgccttagtatatattaaattgagctgaataagccatgtacccagttgaacacaccaaatattttagtgatgtcatttctttattggtgaaagagcaaggccaacgttgatcttaatgttattctctcttttatcttattcagctccctcaacaaaaatacattctcatagattaatgtaatcaccacctcactcctctcaactttagaccctatactagcctgagaaatccagatccaacttaatgagttctcctttatcccaagtcctcatgacctataaatgtaacctctaggacaatgttacaaagagtgagatctttataccacctgcattcttgtcaccaaacgtgtaagttaaaaattcagattctgagtgtggtgactcacgcctgtaatcccagcactttgggaggctgagccaggtgggtcacctgaggtcaggagttcgagaccagcctgggcaacatggtgaaaccctgtctctactagaaatacaaaaattagccaggcatggtgacaggcacctgtaatcccagctactctagaggctaaggcaggagaatcacttgaacctgggaggcggaagttgcagtgagctgagatcactccatggcactccagcttgggcaacaaagtgagactctgtctccaaaaaaaaaaaaaaatttagattccaggacccgaccctacacctccctaattagaatctcagagagtggggccctgggaatctgcataattcataaccttctcagagctctggtacacaagaaaccatgagaatctttgttctggaaacttcagagaacttggctgagggccaccccaggatttggtggcgtccctgaatctcccattagctctgacactgactagacttcaaatatcacagaaggcaagcattgaagtgtgtttatattcaaatagttttcttgttgagaatcagaaatattaataaaacttttgggagtcaaagtaatgagaagacaaggaactgaacttgccccctgatctgttatcatttggcagtaaggtacatattcaacaataggataattctgtataagacctgaatctgaccttctttcatctttcacactgacaattctgtctctaaacacaggattaaatgaggaactaaaattcaccaagatcctgctaggtgtcaggtacagtgctagctgcttccacacatttctcatttaatcagccacctgtgaaattgctatgatttatcaccatttggcagaaaaggacatttagggcacaagagattaaataagctgctggttgggtacattaagtattaataaataatcagatagataagttaggtagttaagtaagctgccagattagtaaacagctagtttcaaatcccagctccaacatttactagttgtatgacccttggggaaactcaacctctgagtctcatggcactgctgataaaacggaaaacatcatcctcacaaggttctgaggactagggatggactcaggtacacacagcacccagtacaatgtctggccttcagccagtgatagcaacccttcactcacctctccattcccttccagcccctgcattcaaaaacttttatttatttatttttttaatttaggaggctctttgctcagaatcctgaaaaggcttttgttactttattttttcttttttttcatcttctgggagcacagaataggcttctgctcctttaaataactttaacaggcaccaaaggaacactgctagctctttcttaattctgtaggtccacatttaggaaaaagaaattgtcagcctctgacttatttccagcttacaaaaaggctgtgatgttggcagcccggggaaagcagttcccgtgagtcatgctttcacctttcagccagtgaagaacaggaaatagtcacatcactattgccaacaagcacagcgaatcgcttccaccaccgggctttcccagatgacgtcagtgagccaagtgcagggcatcacccttgccagatggccccggaagagtctcagctgccctgtcaagtttagcttctcaagctccccagaaccagcatggcaaggatcacccctccagaaaaggaaatgatttctctgatcatgatcaaaccatgtcataattttagctgtaggtggtgagtatcagtgactgtattatagatggttttggttcacagctattttttttctcggtatatttactctcaagggcaaaggggtggcatttatcacaatgctatgattcactctactagactggctgggtttcatttcatctttgagttctagacctaaggccaaaaggatgtcagaatcgccacccagagctagatgcatgctcaatgcaacctggccatctctctcggacagtggccactaaacacaagctgcaatgattattgttgatgttagtcaattgatttgtcccccttttaataatccatgatccacacagacatgaatctaaaccttttttttgaacctatctttttcttactagttttcttacatattttggaataacaatttccctggttataatacacaatgtgtgaaacactaattgcatttattggtcctaaattcattcccaagtctaggatttggggatttagtgcacaaatccactttcttcctgctcatgttgttcatgactttatggattctgcttacatttcctcccaaagccttggtctttctaagcagaaatctgaccagcctctgttcctactctgcttcctccaccaccttgactgttaacatacactgttgtgggagaagcttttcattaaatacgcaaacaaatcaacaataaggaagaaaacaactgaagcacagaaggatgattgtaacatggacttgtgcttgtttaacagtacccatactgtttggtgagttgcctaaatacagagggagatggcaacttaacaggatgggtttggagtctgaattaaataaacaacatggcaaaagaaggaagaaaccaaaagttgggtgactagggcttcttggattctactcaacactttccacacctacaggcctctgattctatccccaccgctgctcctacactgtctatgtttctcttttacaacaacaacaaaaaaatagcacttgtttactgttcacaattattgaaataaatcactctaatttggattcctttatatgagaacttccatatgcttaaaactcccgtagcatttttatagtgtacaggtcataaacatgttgtctgaagatgggcaaagtaggtcgtagagataggaagtgagttcacatcacggcgtgagtcaaggcagcagcatatgagctcaggggccaaatctgagctgtgatcatgtgacacagtcctcaccttcagagatgacattctcccagaagtccagggtgcagaaatggataggctgatgttcacttttgaagaggaccacaatgaaacccttttaatattactcaatgattccacagacctcctgggtgttaaatcaggtgaatctatttttaaaaattgctatttacttttttaggtggctgatcaggacagtatgaaatttcatacagtttcctaacttgagaaaacatggtgatgcaattcctccaaccaggagggatttatggacagcggtggctacgtcctaatctgcccagaatacaggatgactaaacaaattggcaaacggacgcagctttctctctctctaagaaaagtctgctgagaaccctcgttcccactctgtttctgcctccaagaagaaaagcctaaaactcactttcttccggactctttcaaggtcagtggagttcctctggggttcatattcagatactttggggattgatgatggatcataaatgttgctgaagttcatttgagcccatggcctctggtttcagaaccattcagccagtcaaatatttaaattttagtgaggcaggggaaagggaaccccttcgggggctgctatacagcaacttatattcacaattcacaattaaatacacttcagtttctaaatatatgttactttaaaattatacagtgcttagcaattttcaaattttcattttgtgctcaaaatattttcaggaggtagctgttgttatacccatttgtacaagcaagaaactgaggtttcaagaggttatgttgcttaaacccagatctgcctgattccaaaccttatgctttttttaaacttctattttgaaataattatattaagtcacatgaggttgcaaagaaatggaaagtctcatgtcccctttctccaaacctcatccaatgttaacatctaagaaattgacactggcacaatccacagagcctattcagggttcaccagttattcacgcacttgtgtgtgtgcatgtgtgtgtgcagctctgtgcaattttgtcatgctcttttttttttttttttttgagacatagtttcgctctgttgcccaggctggagtacagtggcacagtctctgctcactgtaacctccaacttccagtttcaagcaattttcctgcctcagcctcctgagtagctgggattacaggcatctgccaccacgcccatctaatttttgtatttttagtagagacaaggtttcaccatgctagccagactggtctcaaactcctgacctcgtgatcttcccacctcggcctcccaaagtgctgggattacaggcgtgaaccaccgcgcccggcctgtcatgctctttttatacatgaaccatacactgttctgccaattttaaatatgaaggcagattacagaaataaataaaatgatttttcttttactacaacagtatctaccaataatcacatacatgaccaaatagctttcacttctagctgccgttaagaagaaagaaaaggatgaaaagaaaaaaaatcctataaaccccagttcttgaaagcattagtctgtgctatgtgccttaggtacagattaaggaaacacaatttgttgatttattgataattgtgacagcaatcttccctcttgtcaggaagttctataagtaaaataaaggtaattttaccttgacttcaratttagtctcatcatcttcctttccccgggagttcaactctgtctccgtataaggttcctcagacgttctcagaggacgagctagagggactaagagaacctgccattagtgtggttatttaacttataaactataactcagtgcactttgtctgatttggacaaatagctggaccacgtcaatgtggctaactataaaagctcacttgagctgctgcgttgatttcctagggctggatgaaattggaggtgaaggagagacacagaggagaaatagaatccttgactccagggacttgacatttcagcagaagagaaaaaagtcacacccagcaccatatgaaacattaaactacaacaaatctgtacatatagcaatgtggtaaagaatagtagattttctgtcattcccatttttaaggcccagctaaaaggtcacttttggctgggtttggtggctcacacctgtaatcccagcactttgggaggctgaggcgggcagatcacctgaggtcaggagttcgagaccagcccggccaacatggtgaaatcccgtctctattaaaaatacaaaaattatccgggaacagtggcaagtgcctgtaatcctagttactcgggaggctgaggcaggagaatcacttgaacctgggaggcggaggttgcggtgagctgagattgcgccactgcactccagcctgggcaacagagctagactccatctcaaacaaacaaacagacaaacaaacaaaaaggccactttcctcatgaagtcttccatattacaaactttatggattcttttatgcactgctgctttggcatgcatcatgtgtacagcataatgttgcacttgatgttgttcttggattcaaagactaaattctaggtactacattgtattgaatatattttccattataaaggtaattaatttttgcttattacagaaaatctgaaaaacactaaactcttaacgctgaagcacaatcacttagtatatttccttacagtcttctttcaaatgctctccctctttttacacacatacatgtacacacacaatcatactatgattgtattgtaagaggatggccatgcctgctgctcttgctcttttctcttggccactctatctcccttctccccacctgggaaatatcctttcttcaagctccatggccatttggtagtaaaattgggacttgagaggagaaggcctcaaggcttcctaacccaccttaccagctttgccaagcattgtgggtgatggccacaaggctaatagataagaggtactttgaattcttatttgtcacagtcaccacccttgcatatgctggtcccttgggaaactcacaggagacatgattaatcccaggcaggatttgagcatttctttctttctttctttttttttttgagacagagtctcgctctgtcgccaggctggagtgcagtggtgtgatctcagctcactgcaacctccgcctcccaggttcaagcgattcttctgcctcagcctcccaagtagctgggactacaggcgcgcaccaccatacgcagctaatttttgtatttttagtagcgacggagttttaccacgttggacaggatggtcttactctcttgacctcatgatctgcctgcctcggcctcccaaagtgctgggattacaggcgtgagccactgtgcccagccaattttagcatttgtaggtcccaagaccaaaatgccattcattgaatgccaccaatatatcaccctgattcttagctatggtagacttgatggaggttgaccatctgatctccagaggccccttccaacccttccattctgtgagccaactggaagcagcttgggctttctatgggtttttcatagatgttatgttgaaaatcgcagaaaattacactgctaccccaggttatacatattaccattaatgctgctttgtaataacagacaatcctttgggctcctccctctctgtgggatctctataaagtgagtgattccaggcacaataactagatgctagaaatgcatgcactataatttgtgacaccatgactgagaagcgcctgtccttgacactgtaagtagagtgaagcagtgaaaggcggggccacagaagccacactgccagtgttcaaaccttgctcttccatgcacgagacaaacatgattacagtcacctctgtaccttacctttttcatctgtaaagtagggaaaaatgagaaatcctacagtaaagggctgtgataaggctttaatgagttcatttgtgaagaatgtagatcatatacaatgcataacacattttagctattattgccacatggcactaaaaagttttttcacgttccttatgaacttcagaggtgttagaagttgtagccaaggcatccagctaacaagagtcagagctgaaattccagctcttaagcccctccacacatcttctttatactgtgaaatacaattgcttatcttggcacagactcagttactaaggaatcagacaaaaatgtttgaaaatccttttagtgacttgctggagtccacactcagtagatacttaccaaaaacaaaagtgcaggattgttctgcaaaacgagctagttgtttgacttaggtcaatgacaacctgttcagacttgacaaagacctatttattctgggaaggagtgttatctattatgaaatcttgtatttgaaaagctgagaaacaaccctgtaattcctgctttatttacttgaaacaaacatatgtacctggaaacaacgaatgaggccaagtcatagatgtgaacatagtttagcttgaggacagacgaaaggtcaagagaaccaagttctgtttccaatcatctaagaaggatgtctctgtgtatgtttgggtatgtctgtggtatgtgtgtgcaagtgtgtgagagtgtatgtgtgtggatgtgtgtgtgtgtgtttgcagataaaaattcaggaaagaaatacactaaatgttatcaaggcttacttctaaaaagtaggatacatggtggaagacaagggatcgtaaattgtactaaatggagaattaccaaaacaccccacaattttcatataaacaaaaactgaaagaatttattgctaacaggccaggcatggtggctcacaactgtaattccagctcttagggaggcagaggcaggaggatagcttgagcccaggagttcgaaacctgcctggacaatatagcaagaccccgttctccacaaaaaggaaaaaataaagacaagaaaagaatttgttgctagtagactccccaacaataaatactaacagaagctctttattccgaagagaaatgacacaagatagtaattcaaatctataataaggaatgaagaaccccagaaatggtgaataagggggtatgtacacacacacacacacacacacacacacacacatgcacacacacacgtatgtatttctcttaatttgatacatgactatttaaagcaaaaattataataccatagtgggggattaacatatatagatgtgatatttatgataagaatagcacagaggatggatggggagcatatggaagtatgacattgtagtatgtagtatgatttcctatattttgcatagaatggtatgaaactaattcaatagatcatgacaagttaaggatgcatatggtaatccccagtctggtgaaaaacagtacaaagagatatgataacaagccaatagaggaattaaaacaaaatattaaaaaatatttactaacccaaaggaaggcaggaaaggaggaaaagaggaataaaaagcacatgagacatgtaggataacaaaacaggaactctaaatccaactatatcaataatgatgatggatgtaaacataaaaatctaatcactccaattacaaggcagaggtcacagtgtataaaaaggcaagacccaactatatgctgcctacaacaaatatactttaaatacaaagacagaagaatagaaaacaaaaaaaatatgttctgcaaacactaagcatgagaaaactggaatggctgtgacaatatcgcacaagatagactttaagagtatttctagaggtaaggagggaaggagagacatttcataattataaaagagctaatatatctgaaagacataaaaaccatgaatatgtatgtgcttaatgacagaggtccacaatacacgacacaaacaaatgacatgtacatcctgcccaagggcagtttattccaaggatgtacagttgttttaacatttgaaaacaaatcattgtaatttaccatattaacaaataaagaagaaaaaccatatcattctctcaatacatggaccaaataagcatttgaaaactcaataatcattcacgataaaaactctcctaaaaaatagaaatagaagagaattccctcaatctgataaaagacatctgtggaaaacctatagcttacatcatacttaaagatgaaacttgaactcttttcctaatattgggaaaacacacagatgtctgctctcaccatttctatttgacattgtagtggaggtcccagtcattataatatgacaagaaaaaaagtataaagattgaaacagaaaaaagtaaaagcatccctattcacagatgataggattatatttctatatagaaatctattcctattcttaattatatatggtaaattccattcattatagggttaaaaaaatgttaaatgcctaaggcctttacactcaaaacgactgcattgttgagagaaattaaagatgacctaaaaaacataagttataacatattcaggaattggaaaagtcaatattggtaagataatagttctctccaaattagctcatatatccagtgtaatccctatcataatcccagcagaaattgaaaggtgattctaaaatttatggaacaatgaaaaggacctaaaatagccaaaacaaccttgaaaaagaacaacgttggaacatcgcatgacttgatcttaaaggctgactaataagctatggtaatcaggaccatgtgggattggcataagaacttacctattttttaaatctttgctcaaagaaccaattttactactccattgctaataaaacatgggccttttaaaggtcctgaatggggtctattttatgctgttattattatgttattattatgatgcatttgttgttgttgttgttgttgttgagacagagttttgctcttgtcgcccaggctggagggcaatggcgcaatctctgctcactgcaacctctgcctcccgggttcaagcaattctcctgcctcagcctcctgagtagctgggattacaggcgcccgccaccatgcccaggctaatttatttatatatatatatgtatatatatgtatgtgtgtgtgtgtgtgtgtatatatatgtgtatatacatatatgtgtatgtgtgtgtgtgtgtgtatatatatatatatatatttttttttttttgagacggagtctcgctctgtcacccaggatggagtgcagtggcgccatctccgctaactgcaagctctgcctcccaggttcacgccattctcctgcctcagcctcccgagtagctgggactacaggtgcccaccaccacgcctggctaattttttgtatttttagtatagatggggtttcaccgtgttagccaggatggtctcgatctcctgacctcgtgatctgcccgcctcaggctcccaaagtgctgggattacaggcgtgagccaccgcgcccagcctaatttttctatttttagtagagatgggtttcaacatgttggccaggctggtctcgaattcctgacctcagataatccacccgccacggcctcccaaagtgctgggattacaggcgtgagctaccgcacccggcctttatgatgcatttttattattccttcagtagattgtgtgtttctccttgcatccaggcacttggtgttatctaagtgtttatgtcttccatgtctgcactatgctatatctgtagtttgttttaaatagtatctgttaaaacagcgaccattatccattgtagacaaccagtcacagtcctcatggtgctgatgaaacacaaaagccacaaagcttcttttcctcaaataacctacccgaggtggagggctggctggtttttgatgacacccattttggtgaagactcaggatgtggggccacaggttgcactggacgagtctgtttggctgccagtttcatcagactcacttgcctcttgtgaaatatttcctggacatcatccagcctctgcaaaactttctgggctttggcctacagtaacaaaagcaaatcatgatgaacaggtctctctgtatacagcctgaggacacgaagcattccctttctcccaccttcccctactccccccatccctacctccctcaggtgaccccctctgggcatcactatgcaagtcgctgcaggtcctgccatgctccagaattgggtatctaaggattagcctctcctacttgagacccttgaggacaatgactacatcctttcactatggcgtctccagtgcctggaacaccctggcacaggagtttgagaccagcctggtcaacatggtgaaatcacatctctactaaaaatacaaaaattagccgggtgtggtggctggcacctgtcatcccagctacttgagaagctgaggcaggagaatcgcttgaacccaggaggcagaggttgcactgagccgagatcatgccactgcactccagcctgggcgacagagcgactccatctcagaaataaacaaacaaacaaacaattagaatacaatgtggcttgtgtcatgttagacagagcaaagaattttggcctgagtccatggatggacttcagggcattccccagaattacacaaacagttagacaggctggatataatctgtttgttcctccactgcatcttctcttcctttctttgtgcccaggaagctgattaaaagaagctcctaaaccagaggtgcagacaaggtgatgatgtggctctcagaggaaggtgtgctacctacaaccctgctggcttcatggaagaatatgcttctcaaatgcaaatccaatcaagttatctccctgcttaaatccaaactcgctcatgtggcccacaaagcctaccttgcctgcctctctctaacctcacccaaaacacacttccattgctctctaggttccagcaccctgaccttttggtctgcactgtgccaggctccctccagccctgaagcctttgcacatgctgttcctcctgtctggaaaggctctcccatcttgtctattcgttctccaggctcaagtgactcttcctgagagccttctctgaccccagtccaggtcaagttcctctgtcacatgcctgaccctgcatccctccttgacagcacttatatcagcttgtaacacatttttgtgtgattattttgttaatgtcagcctctcccacaaactgtaagctcagtgagggatggaagcatgcctatttttaatcatcatggtatcctcagcactcagcacagcacatggtacatcaggaatgctcataagcattaatagagaaatgactgatttgagtcagacgaagactcagtatgccaggacgttcaggccgagagtctaagaggccgccggagggcttcggaaccagtgagcccactcaattcagcctgctcagtaccctgtgtgtactttatcaggaagaaggtacagtccctccctcccctatccgtttcccaaccacaggatcaaaataacccggaagcattacctttgcatcgagggtgagcagcaactcaaactcgttgtaaaactccttggggctgagcaacgggtactccttgactgtgcccaggaatgtcgcaatgtcgttcaaggcgatatcaaccccttctcgagactggcacttgtctacagcttgggaagccaagaggtagattcctgcctcacaccattggctgaccttttggaaagaaacagtgccctgtgcacttcgcctgaccacaactcagagccaccgtaatcctcagcaggtctgagcttgtaaggtgtctacaaggattcccagacaatgggaaattgtcatgggacggcatcgagtttaaggggtctaaccactgtaaattacactatgagggggacaaacccaaaccagctgatacctgtccacttctcagggaagtcactcggtcagcaaaatgagtctcttccattaacagtaattgctacatctccaggaggagacagctaaatatatatttaattaaagacagggtttcactctgtcacccaggctggagtacagtagtgcaattatggcttaatgcagcctggagaggtctaccccaggctcaggtgattcttccaccttagcctcctgagtagctgggactacagatgcatgccaccacaccaggctaatttttccttccttcctcccttccttccttccttccttccttcctctttctttctctctgtctctctttctttctttcctttttttgagacaggttttggccatgttgccgaggctgctctcgaactcctgggctcaagcaatcctcccacctcggcctcccaaagtgctgggattacaggtgtgaggcactgcacccacccagccttatagctaaatatctcttaggctggtctaaccatagagaaatgtaatcaatggcttttggggtttacctgctagtccactcttcttgcatccgaattggttaccagaacacagggtgattaataagacattagacctggcccttacatttcctgggagaagggcatgtcccttttaacaaaaacacaactttcatctttggattcccaggtgatccctatttgcatttactggcgtttgtctttcgtaaggaagcaagaatgcaaagctttgtaactcagcacagcgatactcaagagtttctggatgctgggaggacattagataggtgatgagttctaattattcaatttttaaaaaagactcattttctttgctcttttgaactccactgagacacttgaacagaaagacagggagcccttatgctacctgaagagttatatgaaaagaagtttccagtgccaatacctctgcatttccatttaccatgtgacctgaaaagcaatataaagtaactatacagagaaaaaagatcaaaatgcaacacgccaaagtggttgtctttctaagtgggaaaatgataggcaacttaagtttttgtcttatttttttcctagattatttacagtgaatatgtaccacatttagaataataaaaaatcataaagatatttcagaattaataattaccattatgtagggatgggggatagtgggatatgtacgtgcccatgagtaacctttttcttcctacatttttggatttccacaataatatgaactcatgctttgatatatgctgtgaaaactttctctttacacatcatgcccagatctgcaaaaaacattaggctgggattttctgtagagttactatggctacttgctttctctctctctctgtctccctctctctctctcaaacacacatgcacacacacacacacacacacacacacaccaggcttataatctctggagcaaaaatggagttgggaaaacagcagctgatcccacagcgagctcagcacacagagcaggctgcacaccagccccttcggagctacttgcttctgaaacaactatatttcattgacattaaaatccctttagcaatgggatgaggtaagcgcctgggtgggtgccccctgccatgcaagaggaacagctgtggggatggagcatgctgactcattgccgtcagccacatgctgcctgggaccagctcacagggaagactccagaaaccgctgctcctgctgactgggaacataccctagaggtcacctccaaagggcacccctctccttgtgggcccctggcatgcgcccttgctgtctatcctgtgaagccttggtgtggaatctggcaggcctgactttaattctggcttcccctgtgtgcaccatgtgtggtcttgggcagtcatttaccccagggtttcttggtgacatccctgcaccacctgcaccagaatcatttagacactttactaaaatactagttcctgggcagtattccagacctatcgacgctgagtcttcagggcagtgcataagggaatctgccatataacagctcactaggtgattctcgtgtgctacattttgagacccagcagagtatcagtttctgcctctgcacaatgaggccattaataccttcctcagaggttgtcttgaggattataaatagatgacataattatgttcctggtaggaatgcagtaggtgctcgatacatggtagggggtataaaatggttgttattacttaagcttctccaaaaagagtcaaaaccctttgcctttatatgagggaagcactctgcaaatatagtgcttggttctctgtacacctgaaagggaatcaagaagtgttcccacagggccaagccaaaacacactcttaaagtccggctccacacagatagaaatgggcttcagttaactttaatgggatgtggtgggatggccagagcactttttaccttcgtgccaggtatacttctacaccccaggatctgcacagtttttaatgcctctcgaacatcttttcacataaagcactcaagcctctcagcaatcacacaaggaagggaggacgagtatgatggaagcttcttcacagaaaatcttgcagacatcatgttcttggctgtgttttgctcaccttgtccagctgtctatgaaactctaaggactttcctaaaatgtcccattttttcttgtttccattgatgaaatcgtcacagaggtgcctgagctccacacaccggggcctgatggcatctgctgcataatggtggctttggatgagctggtccccaaccagtgccagcagcwgggccttttccaggggctcctgcaaagtgaacacccacagccaggcgtcagaagtcagagcatcatgaggctgagagctgcctggtactgtgtgctccaagcctggagggaggctgtggagatgctaacccaggatgaaggctggagaacctgagaaagctcggaatggttccaggcccaggaagttaagcctggcccagagttgtccacatgctgaacaacagcagtcattcattcaaatacctgttgagttctgggctagacatcgaggatatagtgttaacaagcccaaaattttcagattaatggagaattcagatatcaactaaattacacaaatcgttaaattattacaattgcaataaactctagggcagaaaagcatggagtgcacataataagagattttgaatacccctattaactaaaggaacaagaagagggactgacacctgtccttgaggagagtggggggtgagctgaagttgaaacactggtgaaaattggatttggacaactcaaaggtggtcatgacacttaagaaatatgcttgtctaggctgggcgtggtggctcccacctgtaatgccagcactttgggaggccgaggtgggcggatcacctgaggtcaggagttcaagacgcgcctgaccaacgtggaaaaaccccgtctctactaaatacaaaaattagatgggcgtggtggtaggtgtctgtaatcccaactactcaggaggctgaggcaggagaatcgcttgaacccgggaggcggagattgcagtgaattgagattgcgccactgcactccagcctgggtgacagagcaagactccatctcaaaaaaaaaaaaaaaaaaaaaaagaaatatgcttgtctaaaccctttcccaaagcctgtaagggccctgtctacactgaccctgtctgctcaatcacatttcctacctctttctgcatgacacttcgctctaaccacacgtgccaagttttcctgtttgtttaagcattccttcattcatccttctcatattattgagaacctgctatttgccaaacactgtcataggtgctgggagttcattggtaaagaaagcaggcaaaaacccccacctcatgaaatgaagcttacattttaatgggagacagaggcaataaacaagtgcatgtgtaggtcatatggtatcttagacagtgatgagtatgtggagaaaaattagatggtggggagggcagggagtgctggagctagtattttaaatcggatggtgagacagtctccctgagaaggagtactcaagctatgcagaaaagacttcacatagaaagcctgagactaggccgggctgtggtggctcacgcctgtaatcctagcactttgggaggccgaggcaggcggattgcctgagttcaggagttggagaccagcctcggcaacacagggaaaccccatctctactaaaacaaaaaaaattagccaggcatggcagcatgcgccgatagtcccagctactctggaagctgaggcaggagaattgcttgaacctgggaagaggaggttgcagtgagccaagatcgtgccactgcactccagcctgggtgagagctaggctctgtctccaaaaaaaaaaaaaaaagagaaaagaaagcctgacactacagccttagaaagaaagacccgattttaagattggccctttgttggcatctaggaacttagatttttgggaaggtttcctccattccctgatgtgaatggttcatgatccctgaactgtttgtgcaaacagtatggtttatggtgattacttgctttttcttctgggagtctgaaatcttggtacttgccagacagaagctgctgacatgaccagccaccaataaaacctctgggcattgagtctctaatgagctcccctggtagacaacatttcacacatgttgtcacaacccacagacgggggcaggaagtatgtcctgtgagactcccacaggagaggattctaagaagcttgtgcctggtttcctccagacttcacctcgcatgcctttctcctttgctaattttgcttagtactttctcatcttaatagatcataactctaatacagctacatgcagaatcctcctagtgaatcttcgaagaaatgtgtgcatggtcttgggagcgctctgcatacaagctgagacctgaagtcagggacaagccgtgcagtacttggctgggaggtgaaggcgtgtttgacaagtttgggtagcaggaaggaggccagtgtggctgcagcagagggagcaagaaggaaatgagtggaagactaactagaggaaagagggggttccatagccggggtgagaggaaagcccctgggtttggagggaggatctcgatcatgtttttgaaaggaccactcccggtacagtgtccagaataagaggaaatgcagggagactcattaaggggctgctgcaggaatccagccgagagatacggcttacggctggtcaccaaactagctcctgactcgacccttctctggattgttcttccctgggtcatgcagagctgagttcctgggtcacctcctcacagcgcttccctggcgactatatcttaagtcattctctacaacctattcgcccagtcacctaggccctctcccacactttaattctttaacagcattatctctatctaaaaactattttctttatttactttaatgtagaattcctccctcctggctgggcgcggtggctcacaccagtaatcccagcactttgggaggccgagacgggcagatcatgaggtcaggagatcgagaccatcctggctaacacggtgaaaccccatctctactaaaaagacaaaaaattagccaggcatggtggcacacacctgtagtcccagctactcgggaggctgaggcaggagaatagcttgaacctgggaggcggaggttgcagtaagctgagattgtgccactgcactccagcctgggcaacagaatgagactctgtctccaaaaaaaaaaaagaattcctccctcctccactcactcccaccaaaatgtaagttccatgagagcatttagtaggcatgcaataaatatttgatcaacaaaataaatgaatgagccaatgagctacatgatgcggtgacctgcttggctggaactctgtgaagcaatcagcacagatgactgccacattccaaaaggtctccaggagcagagagcccatgagcccccttgccagccacactaagcatccagtgcatcactgcactgctttagctgtttacagtaacacaaggagtcacggtaactccaggtgcgtacatcttgcccctctcttaacttgcactggtttatggtttcaacaatttccaaacccctttcctcttaccctcccagtcattcacgaagccccgcagggaccgtcgccttcttaatgcctttcaaattctgaccccatctctgccacctccttgtcactgtctgctcaggcctcatggcttctcatggggacaactggtctccctgcttttcttcaggctctccttcaaatcatgctccagactgctgacaaaggagcaattccaacatatcttattgtgtctacatcactcccaagcttcaagccctttcctgggcgcccagggtcttcaggagcaagcttaaactcttgagcaatgcacacggggaatttcattatctagctcatacctgggtgtgcctgacttaccaagtcctcttccacttcctcaactccattctctgctgcaaccatactaattatccacttattgttccccaaatattcaggcagcttcaggcctccatcccttctccacctgctgtctgcctagaaagcccatccttccctactccccctcacccatactcctctggggccaactcgatctaaatcatatttcagacttcaccttctccagaaaactttctctgtgcttctcttgatcagagcacctgcttcattatgttgtgaccacttatctgctgcctgcgctatgccacagacacctatggtccagaaccagctcttattcaactgaaaacagtgcatgctgcatcttaggtacttacaaataaatgctgcacaaaacaaagaggagtactggtatagaaacaagtgacacaaatcaagtagtggctagttaaaaggactgaggcaaaaatacccagaacacttgttctaaacagcaaaggcccaggtgcactggttaccacccctacaagatgactggaatactcattccctgggcagtgattttttttttttttttttttttgagatggaatcttgctctgtagctaggctggagtgcagtggcttgatctaggctcactgaaaattctgcctccggggttcaagcgattctcctccctcagcctcccgagtagctgggactataggcgcccaccactatgcctggctaattttttttttttttaatttttagcagagatggggtttcaccatgttgcccaggctggtctcgaactcctgagctcaggcaattcacccgcctcggcctcccaaagtgctaggattacaggcgtgagccaccgcgcctggtctgggcagtgatttttgactctttggttcactgctgtgtcctcagaacttaaacagtacctggcatggtaggagatgaataaatatttgcagaatagatgtcgaatgaatgacagacctttcctagcactgctcagctaccgcagactgaacctagcacatgttccatagcccagaatttatccctctacctctgtaatgttaataacaacagctaacatctactgagagcttaacagatgccaggcactgttctgaatgctttacatttgcttatttccttaactcttcacaacaaaccctttgatacaggtactgttttaccaaagggaagtggagcacaatggcccaaggtgacccaggtaggaaagagaagagccaggcttcaaacccaggcagtcttgctccaggatctggctcagaccaacatacacagagaaaaatggctgcacttgttctgcctaaacttagagacctcatttggttgctcgaacttgtctgactttagtcaaatatagaaacatgagacttggcatgaaagtctctgttgacactttttttttttttaagtccagctgcctaatttattaagaacagggcagaattttctgggtccagggaaattcaccacaggatacttccaaatcaccctgtggtgatcagagcctgcccttccctcagcatacagtatttcacccttcagaattttccagaagacatttgagatgttagagggaagatgtgtgtaacaggtccaaatgggtctagggagaaacgcccataaaggcaactgaggaggccgggcgcagtgggtcacgcctgtaatcccagcactttgggaagccaaggccggcggatcacaaggtcaggagttagagaccagcctgaccaacatggtgaaaccccatctctactaaaaatacaaaaattagccgggtgtggtggagggtacctgtagtcccagctacttgggaggctgagacagaagaatcgcttgaacccaggaggcggaggttgcagtgagctgagattgtgccactgcactccagcctgggcggcaagagtgaaactccgtctcaaaaaaaagggcaactaaggagcaacccggattcagccaccacatggctggaaggtcactattacagaattgaaaggacaacaatagtttctgaccactgactactgaccaccaaccatattgcaagctgaccacatgaagtccctaccacacatctaactcatttaatcttcacaaggtctctgtgaggcaggaattattacctctgctttacagatgagggggaccatattcagaaaggctacgaaacgtgactagggtcatacagctggtacttgttagagccaagatttgaatccatccctatccgacttccaaagcctgtgttcttgtcaccttccagcccacctggcctctacacatgtgctatgaaatcctcctggtgcctgcaaagaaatttatggtgaaacctccaaattgaagcttatttttttagtttatatacctcccactcaggataaatagtcatcaaaatctccaaagtaaaaaagaaagagtgagggaaaaaatggctaaaatcttctgatcacaagcccatctgggatctttcagatgctgaaaattccagaaggctggatcgtcaagtttcagcttagaagttgcaatcagaaatctttattgaaataagtttatttccccccgaggactctgctggtataacagatgagagatgagagtgcctactagggaagaaagtggcgagaaagcgagtgatgctactctatccgggaatctagaacaaacccacagaggatccacagggatggagtgtgtgtatggggaggtgggccagatgaaacaagaaaggcagaaagctaatggttgttgaaattgaatgatggacacttggagttcattgtgccagtctatctgcttctctgtgtgtttgaaaatttcacacatgtacacaaagccatgaccctccaacaagatgacatccttagatgttaatggcctgggttccatgccttcttagacacagcacccttatggggagaggtcaaggctgaaatcaggtggttcctccaccctgtcctggtctgttccctgctggcccctcagcaagggtctcagtacggcccacagtcaaaaccctgcagcaagttctgcttttatagaagaccttctgtaagtggttgaaactactgtttttcagaatcaggaaggagcattcaaaagactgctaaaccctcaaacgagaacaagataaagaacaggctgaatcagcatgcgacaggagcctggttagtgagttgactgaggttacttgtgagaatgatgtcactgtgtggaataaggaagctggcaacaccccagagccagcgtgtggctgtgctgggagggagctggccccttagtgccgagtaaaggacaaactccaggcagatatttgtcagattgtggccagacacagtcttgttcctttaacactttaaaggacaaatggaaagattagccaagccctaatcatctgaagaagccatgtgtctgagaagtctgagggaagatatattgaaaacgatctcagttacgatgagacagctttgtttgatttacgcaaaggcagagacacaggtgtactacatccttcaggaagcaagtttagaaataagatctgcaagtcataggatgtgacaggtctgcaaatcctgcaagtcacaggtcatccacagtgggctagtctagctgcttcaagaatgttgcccacgaaaggtgggtcatgggttcacagagcattcctgtgttccataaccacaggtttcatccctaactctggtcagcaacttttgaagtatataccaaggaccacaagttcaaggaagtgggcagaagaaagaatgtgatgcagtcatgcagatccatcgccactattcaagacacagcccagagcgccttccaagggctttctgttccactgagaataaaattcaaatcctcacaaaagatctcagggtgcaacaggactacctggcctctgctcatctctgttcactcatttcctcctggcccacctgctctagcaatgttccttgaactcaccaagctcatttccactttaggacctttgcacctgcagctcgctcttgctttgatactattccctaagtctttgcatgattacacagatcaaacagatctcagaccaaaggtcgtcttctcaggcctttccagaccattctagctaaagtagcatccccagtcactttctattatatcttgttttcttttttatatcacttgttactatctgatgttattatttatttgattgctttttagtgaactgtctctctccagtagaatgtaagctccatgagggcagattctggactgtctggctcaccgctgcacccacggaacctaggataaggaatacctcttgatgaataaataaccctctggataggtcagtagctactttcatatatatatgaaggcattttttttgatgaggcactttttcttaatatatgaataagcaaaaaaatatagtatctatattcagtaaaaaattattttgaaaaaactaaaatgatataaggttggggctgtcctggagaatctaaggtatctagtcatcatatatatgaaattcaacttttccattgtttgataaatgttcctgatgactcatgtgtctttagcactagtttatctgtcaaatggtcactggtaagagaaagagcgctcgctgtgaagggatgggattcctgaatggggatctggatacacagctgggtttgtgtgttcatgcatgtgcacaagcacctgcagctcagaatctacaaccaacagctcttagagtcagtgtggccttggtatactttgttttgtatcctttaggggtgtgtgtctccaactttaacgtacaagtcaatcacctggggatcttcttaaaatgcagattccaattccagggtggggtctgagattttatatttctaattagcgcttactcaggtgacatctgtgctgctggccagaggctcacactttggcaaatctctagtactgcaaaattgccgtctgagaaacatgcctccagattagctaagaaaggaagcgctaaccacaggggacttggtccccaagacccaaaaatatagagaacctaatttcaaacaagcagaaaggaacttctctggaaagagacgactcagctttcttcatttgtaataaaccaaatctgtaaacacttaaaatggaatcatttctaaatgctgacttgtgtgcggatctgggacactgtttaattccagtatgggactgtaaaatacatattcttttacaagtttcacatttacaactcttgggacatgagaaaggagaaagctttgccaattctgtgtagcaatggaactaacatggaccaatttcccccatctaattgtcttgctccaggtataaaactagttgtttttttttttctggtttctcctttgaaagtttcccatccttactaccaaccccacaacccccagccccctagtccaggctccagggaggagctcaagctgatgggtgagcctctgatataattgttctggtgagtgatgagcctgttgtgaccttctcccacttggctgctgaccacgtgagagggcagggctggtccagagtcctcacccgacctgagcgtccaactgcaactgtatgttccggcagctttaataggactctgtgctgcccgtattattcatagcagttgttaatgtgcctctctccttgggatcctggggtgactgaagggcaggactgggcattcctgtgtcctttagcaaccttccaatagcaatgactggacatgatccatcattgtccacagcaacctccctcccagtacacaaaaatgtcagaaagcaaacctggcttttttcctccagttttttgtgttccttaagaakctgctccacgtgcatcacgctgtctccaatgcctgtaaactctgcttgctcttccagcaaattatccagggcaagcttagcctacaagaaacattagaacagtccagaagtaaaccaacactcactcacct

SEQ ID NO: 4 - DNA, 133100 bp, Homo sapiens
attcccacatttacagtaacccctgtttccagaaaataaatatcaagataaggaaagtgacactaaagagacacgcagccactctgcctgtaccctctctggaccttaaagagttaaagcctagccatgatttcctaccagggctgaggctaatgtaaaccacctgctcagacrcaagaagcaggaccagagggtcaagttgctgagctctgaagtctgttctgaaaaagcttcagttttaagtacagaacaagtgataggccaaaggccagagggtctgagctgcagcagcactgctctccttaccccgcccttggcctgggtgccagctcctttgagactgcctcttagccacttactgcccatcaagggaacaccagacctacctcaagataacaccaaagtgacctttggtcccagagagttgttaaactataccgatctctcagctcatgggcccttgcttctgctgaaccctcattctcttagtgctaactcccactcccagaatttcagggcccaaagcccacacaagctcccacctcaaagggtccttcccagaaccccacccccttctccacctgatagttccaaaggcctacagcctcacagctcacaaaggaaatggctgccccatctgtgcgccagtgctcacttgcaaaatttaccaccacttaccctgagacgctgcctgcctgtagcctaagaattccatgctctgtacccctttcttagaaagatactccccatctgagagacactcacatccaaagagtgaaaaccctgatcttggggctcctcctcctccaactctrggacggataggccaggaggcacatgcaagcaaacaccgagatctcacctggcaggttacccagaggggccaagccaccttgccctaggctaataagctataaaaacagcataggaaatactttgctggtacatcccctgcctctgagaagataaaaggcaagaggaccagtggctccaagagacgccatacagagaaaaacaatctttctcaattcctggggagtcctgggtagaccgtctggtccaagtccaaagagtttcctgaggtcggggcaaaccagtttggtccatctaaagggactagcttgggctgaagcctcctcttcacacagaccactccatctttgtagcctagagtttggcacagaaccccaaagccctggagaggaacaagggagggattacagaggaaaccaagcttctctggtttcttcaaaagtggcttacagatgtctgccccttctccccgttctctggagggtccagatcaggatgatggcaaaagagctgcaatcaggaaccagacctgcaaccaggcctgcagccatgtattgtactggggcgcgtacacatacacacacacacacacacacacacacacacacacacacacacacacacacacacacacacacacactgacctgggccccccaccactatattcacacaccctggtccctatcagctgacaaaatgaaccttttttcactgcccaccaccgtgcacacacccacggcctcacgcagaaatggtgaagccctctcctgagctgtctctacagctcaacgtgcaggcaaacacgctttccttctctgaacaaaaacatgctgacatctacgcaagggggaaagaaagcaaccctttgctctgaaaggcgccaactcccggatgttggcaagctctgctccacagcgcctgtttctgagtatgtttacttgctctccctcttctctccctcccctttaaggatggcgcaggaaagggaggtgaggggggagaatccaccccaccccctcgtccatgtttgaacaaaaacccagagaaagagtgagggagaaaaagtctcggtgcgggggggccttaccagactcctaaagccaaacgtatctacaggttttaatccgccattagcatttaaatcttgaaaggagaggaggaagggggggccagtggaaagtaaccccacacacaaaagaaaagttgttggttttcttctcagtctgcctggcaggagcgatcttcctggctgacagccagaagtgcgtcacagccaggagtctgctttctttaaaggcacagcaagcttccccgatctgggagcgacagcaagcaggggactctcagtgggggtggggcccagagggagggggtgcactggagaggaggggctgcaaaggggaaggctggaggcttggtccacgaacaagaaaagcaggacgaatgggggcggcgggttgagggtgaaggcacaagcaggcaggcaaaattactgaactccaacagcagcaagagccaaggcaaactgtggcataaacacacaaaacacatcttacagtggcctgcctgacaaactgggatcaaccggacactcccccttcgctctgttttccacccagagtttaaggcagcagtaataatctgtccatctctctggacagcaatggaagggtaggacaagggctgtcctgataattagatcagcccctgcctggcggaccgcagggcaaggaggaagacccgggaacagaggctttgaagaacaagcaacatgcaggccctctgatcgggggcaccttcctgccggccccagggcaggctgtgtctttaagtacaaccatgccactcacacacaaagcgccctgccaccttccatgggcaccgcctgccctgctctgggacacggccacccactaaatccattccccgagggaatctctccagcccataccttctgcgtggcaaggccaggatgccgtgctgtgcccgctcctccccctccgccacccaaacaagaagcccaggcagattctggccctggagtacaggcctgcgctgtcctgtgctgcgtgctattgtcggctgtggaatggccgccaaaatcccagctgtgctgccagaacctaatcccctgttccgctgagcatttatggggaggggctgaggggccaaggcacgagaccgagtacgccaggcactggctgcagcccttaacagacgcaggcacggggacttgtagactctgcttctcctacatggctgaaaacaaaagatgtctgactcttagaagacaaaatcacagcatttccccccactgaatagcgaacttcaccaaggctgaaagggaagcccaccagatggtcaacaggcaccccctaatcttatgccacaaacatttactgagcacctactatgtgtaaggcactcctataggaaactgtaggaagtatacaaagatgaattaagcccagcatccgcactgaggtaggttgtaattcacaggagataagaaatatgacttgaagattaatttcaaactggtgtgctaacttccataaaagctgtaaagaaaaattctaaccagtttagaatagggaaggattacgaaaatgaagtgccattttaatttggaccttgaaacacacaggtagcatttccccagatrgaaacagagaggtgtggggaggaagagaaagcagagaggaggcatggaagcagtgggagaaagggcttgaagagtgaggtggggtcagagagctaggagaatcttgaacctcaaaccaaggaatcaaagacttgtaagtttgtttgttattaacacagagctgtggtatgacaaaaactgtgccccaagtttattctgatatatacctgaatgagactagcagcaatgaggtgagtcaggaagctgcacagtcaggagacaggtaatgagggcacacaagagggtaaggtaagaaagaatggaaaggggccttggcacgacggctcacacctgtaatcccagcactttgggtggaccactgaagtccgagagttggagaccagccggggcaacatagggagatcccatctctacaaaaaatttcatgaataaaaaattagccgggtgtggtggcccgcacctacagttccagctacttgggaggctgaggtgggaggatcacttgaacccaggtggaagctgcagtgagagacattgtggagacagggtaaagaactgataggaggcagagagaggaactgtacaggggaggaaagtatgagggatgatatgcagaattaaactgaggagatgacaggatgtcagaacaagagagaaaacagagtataataaatagtagctggtggggcacggtggctcacgcctgtaatcccagcactttgagaggccagcctgggcaacatggcgaaaccctgtttctaccaaaaaatacaaaaaaccacacaaaaaaacaaaaacaaaaaattagccaggcggagttctttttttttttttttttttttttaaagcagggtctcactctgtcacccaggctggagggcagtggcgagatcatagttcactgtaacctcaaacttctgggatcaagtgatccatctgcctcagcctcccaagcagtgggagtacaggtgtgtgccaccatgcctggctaatttttttttttttttttttctgtagagacaggctctcactatgttgcctaggcacagcattattttaaattcttctctaaaaattctatgcttctcccaaagccctgggatacaggcatgaaccaccacacctggcccacagttgtctttgtctttttctactaggagctatactatagaggtcacaatcattggctacagtttataatatataggctaaaatgttttacatataagataaccagtaaaacttcatgatttagaaacaaattagtgtcttttttagtgtcagagtcccagctactcaggaggctagggtgggagaattccttgaactcggaatgagcagagatcatgccactgcactccagcctgggtgccagagcaagactctgtctcaataaatacataaataaatggacagatagataaacagagagacagaaagacatatagtagctaatgcttactgagtgcatactatgtacgcgacactattctactgacctaatatgtacgaactcattaatcttaaaaactcccttaatgaagtaggtaccattatcacccaactttagagaggaggatattgagccacaagattaaataatttgccaagatcacatagcaagtaaatggcagaagtctctaccacatgctgctaactatttgacattggcaagaaacttctgaactttagtatccctatttgtaaaacaagaataaagacacctgttataaagcaatgaaaattaattcaataacacctataaggtgtccaacacactggctagcatgtaaggcataggatgggtgtttcctgcagactaattcctacttggcattttggtcccttgtcaccaaggtgtccaagcagaagttggctcaccaattgtttgggaagccagagagggtattctgcctggagcaggagactggatcctctgtctgtctgccttcttcccatcagtctgcctctctagattttactttagggtccagctcaaatatttaatatatttgatttaatattcctaactcctcaaatatttaacagttaacaggggttactttggggggggggaggagttagattgtagggaacattcacttggggactttctatgctgtatgtttgcttttttttttttttttttgagatggagtcttgccctgtcacccaggctggagtacaatggcatgatctcagctcaatgcaacctctgtctcctgggttcaaatgattctcctgccacagcctaccaagtagctgagattacaggcacctgccaccatgcccagctgatttttttatttttagtagagacagggtttgaccatgttggccaggcttgtctcgaactcctgacctcgtgatccgcctgcctcaggctcccaagtgctggattacaggtgtgagccactgtgcctggccttgcatttatttttaataatcttgtattacactggtgataagaaaaatgtaactacctcctactcttggcacttatgtgtatatgcatgaaaatcttgtcttcacatctagaatggaaattcctcaagggcataaccagttccacctctctctctctgtgatcccccataacacctagcacactagggctccttaaatctgcttctccaaactacatctggatgtcaggtttacaaattcaactttctggccaccagagaatgactgtggtgggtggttgggatgaggtgggggtgggggtcagaccaaggctcattgctgtaggctccccatcacctgctgcttcttccaggccctgtaagctattcccactgtatcatttgtagtctgtagttagcaatcactattagtagaaatggaagttcttatccaaaggagcaccatgaaagcaaaggcaaagcagataccaaaacttttacagaaaagcaaagtggcaaacataattgtttgggtttttgttgtttttgttttcttgagacagtctcactctgtcacccaggcttgagtgcaagtggcacaatcatggctcactgcagcctcagcctcctgggctcaaacaatcctcccacctcagcctccggagtagttgggaccacaggtgcatgccaccacgcctgactaatttttgtatttttttgtagagacagaatttcaccatgttgcccaggctggtctcgaactcctgggctcaagcgatctgcctgcttcagcctcccaaagtgctaggattacaggcatgagccatcacaggcctggccaaacttaatttaaagactggcattatcaatgctccagaaaatgtataaggtgaaaataggagggaggcctgctaaaactgccctggccacatatggcaatgcatcagccctgaagcttcctagcccagatagaattgatattgtctcaaaagcgtacaagaggtctccccagcctggccccttgctctaaactcaaggcaacagcttccagctgtgcagcttccgagaggctgaaccttcccctagaacccctctgcaaagctgccaagtttctgggccagctcttcaggacagcccaaggagcctggccagtttcgccaggctttccctcctcttcctccctcctgtggcagcagcagaatttccacagcccctctcacagcctagacaggcagcaggcggccacatggctcctgcctgattcttactgtcctcagaagagcgggaaaggagtggtaaaacctttctagaaaaagagaagggccgggcacggtggctcacgcctgtaatcccagcactttgggaggccgaggcaggcggatcacctgaggtcaggagttcgagaccagcctgaccaacatggagaaaccccatctctactaaaaatacaaaattagctgggtgtggtggcgcatgcctgtaatcccagctattcgggaggctgaggcaggagaattgcttgaatcctggaggcggaggttgtggtgagccgagatcgtgccattgcactacaccctgggtaacaagggtgaaactccatctcaaaaaaagaagaaaaagagaagaaagaaaggggtggagagcggggagagggagagagagagagagagaaaggaacaaaggaaggaaaagagagaagaaaggaaggaaagaaattactttaaattcagtagggagggctgggcacagtggctcatgccttaatcccagaactttgggaggtcgaggtgggcagattgtttgagctcaagagttcaagaccaacctatccaacgtgacaaaatcccatgtctactaaaaatacaaaaattagctgagtgtggtggcaggagcctgtaatctcagctacttgggaggctgaggcaagagaatcacttgaatccgggaggcggaggttgcagtgagctgagattgcgccattgcactccagtctgggtgacagagtgggactccattgcaaaaaaagagaaaaaaaaagaattttaaattaaaataaataaataaatttcagtagagttcagatagaggttgaagcggggtggtgactggttaggagcacaaaggttatttcaaagggtcaggtgatcctcctgcctcagcctcctgagtagctgggactacatgcacatgccatcgcatcaggatttacattatcatttttgaaagtttaaacaaaaaaagactggagctgggtgtggtggctcatgcccgtaatcccagaactttgggaggccaaggtgggaggataatttgagctcaggagttcaaattcctcaggagttcaagaccagcctgggtaacatagcgagatccccatctctacaaaaaataaaagaattagccagacatggtggtgtgtgcctgtagtcctagctactcaggaggctgaggtgggaggattgcttgagtccaggagtttgaggttatagtgagctatgatcatgccactgcactctagcctgggcaacagagcaagacacgtctcaaaaaaaaacaaaaacaaaaacaaataagtactaggagagttcaagtccccagtcatccccatgggatgattctcacacaaataattagcctggcactcaaggccctccatgacctgcagcttctagagttctagcttctagagtcgttattcccttacccaaaccctccactctgccaggcaggtctataaagttacagtttgtcctgagaattagacaagatgaccgcaggggacaggctctggattagctacgaattacaacagtaacagcaacgataatgatagtctttactatgccaggatgtaagtgacagagaaaagactagaaggcattgtattgggcagttttgtttattttactttatttttttaataaaattaaaaaatatatggaactcttcacaaatttgcatgtcatcctcgcacaggggccatgctaatctctgtatcgttcctattttattttgttccaattttagtatacatgctgccgaaccaagcactgggcagttttaaaaatgaagaaatctgaggctcaggaattaggtgacctacgtgatctagtcatgtaagtagtaagttgtctaccttgtccctatattattcttttttgtttttttctttcaagatggagtctcgctctgtcgcccaggttggggtgcagtgctgcgatctccgctcaccgcaacctctgcctcccgggttcatgtgattcttgtacctcagcctcccgagtagctgggataataggcatgagccactgcacccagccagcctatattattgtctacagctgttaaataggcaatcattgagtgaatgaataaaagctagcacattctcagcaaatcaaagaagccgtgtgcttttcctcatgaaaatcaacttttttttattttttgagacagagtttgctttgtcgcccaggctggagtacaatggcacgacctcagctcactgcaacctccacctgccaggttcaagcgattctcctgcctcagcctcccgagtagctgggattacaggcgctcgccaacatgccggtctaattttttttatttttagtagagatggcgtttcaccatgttggccaggctgggcttgaactccttacctcaggtgatccacctgcctgggcctcccaaagtgctgggattacaggagtgagccaccgtgccaggccgaaaatcagcttcttaatcaaaataatcaaacagctccaatttcaaaattaatcactaaagaatttttttctgaggatccgagagctttacaaacactraagggccaaaactcctctaaaaacagcaagcaccaagaaaagtcttgtactaggagggatgttggcagtgtctcaagggttagagggggaggctggaaggaaatgctggtgctaaagggaaggactgctgtttcaggagcctgaccttgagcttatttaccatggcctcattgtccctctccagaggataatggctgattaatgaggcagtgttggtaagtctgaggcttcctggagagaaaagcagagggcaaatcaaaacccagagaggattcattataacatccaacaggcccactcagttctctctcaagaaggcctttctacaaaacagctaagaacctctccaccctgtttcactgtcacagaggagtaaaatggctctgtccctacaggcaacatatcaacatatctagcacaatgtttgctcacaaacacagaactaattataagaaatgtgaaagaacctgaaacgcagggggaatactcttactggagacagcctccatagtggtagaaaacatagtagatctggtgttgaaagcccctggaggggtgatgggtcacttactagctatgtggcttaatgcaagtcacagaggcaaattactgagaaccaagctagggtcggatcagctctaaagtaccttttcagggccaggcacagttgctcatgcttgtaatcccggcacttttggaggccaagatgggaggatcacttgagccaaggaatttgagaccagcgtgggcaacatagtgagaacctgtctaaaaaaaaaaataataataatatatatatatatatatatatagtgtgtgtgtgtgtatatatatatatatatttgcctattcatctatctatagatagataaataaatagatatatatcaaaaaaagaaaattggctaggcatggcggttatgtgtctgtagtcctggcaacttgggaggctgaggtgggaggatcacttgagcccaggagtttggggttacagtgagctatgatcatgccactgcactctagcctgggcaacagagtgagaccctgtctctaaaaaaataaaataaagtacctttccacttccaaaaattcccatgattctttccacaggataccattctcaacaacaaatcttgtagtagaacttgtctcctcagaatctggtcaaaacatcactagttagggtgttctttcaaaaaaaatagcaaatctcctagaaacaggcacattgtgtgttaccctattaggacccatccccaaagcgaggcacatgtgggtgcttcattaatactctgttgaaaggaggaggtccttggaaactggtagtaccaacttagcatggcatacaatgaaaggtgattggagccacactcgaggaactacaaggcagcttttcataaataaaagccacaaaatgcaatttataactacatctgtctaaacagactaaagaaaagtagctttctatacctaggtcttcaccccttctcctccccacctctctactttatcatccctgtcctacacagcactgagacccgtctttctggttccaggtccacttttcctttttccacaccagaatgcctttaatcactgatagaaatgaacaaacatgaatatgagttctaaacaggaagacagatagcctcaagaaccaacttgtcaatatgttactaataagtgaaataagtgggaatggtgtctaacatgggcatgataaaataaaaccctaaaatacatactgtgctagggatttgaacaaacttcaggatttttaaggaaggctgtgtctcacatctcaattaatcttcccaaaagaaccctaagaggcaaggtttattccaattttataaattaggaacgtaaggctcagtaaaaagaaaatacctgcctcaaggtcgactggtaaggctgcagagccagaactcaaagagatgtcttctaaatccagtgctctctccagcacatctcagctacatcctctatctttctcatcagtataggtcttcatgtatacaaagcatttctgcattcattgttcacactgcttctgccacagctcatgaaaaggacaatgcagatgtctaaatggcaccagatctatacccaccttttttttttttttttttttgagacagggtcttgctctgtcacccaggctggagtgcagtggcataatcatagctcgctgcaacctcaaacttctgggctcaagtgatcctcccgcctcagccttacaagtagctgctgctacaacaggcacgcgccaccacgcctggctatttttaatttttagtagcgatgaagtctcgctatgttgcctaggctggtctcaaacacctgggctcaagcgatctgcctgcattgacctcccaaagtgttggaattaaacggtgtgagccaccgtgctgtcctatccacacttttaaagatgctaataaataacgtgatcaccatcagagaaaataaatcctacgtatctggcatcactgagaagtacaaaatttcacacaagcaattttcctactaactgaaatttatcccttttaaggcaaagctctttctttatatcaaaacatattctccaaaatacataagatatgttactctttacttagaattaatgaaatttaatcagggatattcgactataaacatgatataaacatcctacatactgtgctaggaattcaaagatttttttttttttttttgagacaaggtctcactctgctgcccaggctggagtgcagtggtgcaatctcagctcactgcaacctccacctcccaggctcaagtgatcctccctacctcagcctcccaagtagctggggctaccggtgtgcaggaccatgcccagctagttttgtactttttgtagagatggagttttgccatttgcccaagctggtctcaaactcttgagctcaagcgatcagcccaccttggcctcccaaagtgctgggattacaagtgtgagccactgtgcctggcccaagggtaaatctttaaacttgagtttataatcttgtagaggaagagacacatctgtaaccataatatgaagccaaagaacatgggcttggggtgtgctgaaaggaaggtaagataacacaagcaaggctagtggggaccaacaacccagggtgacttactgaagagaagtgggaggcactgaaaagtcctgggcaggagaatggtatactacttgtgctttttgaaaagatgactctagcacaacagtgaggccagaggcagaaaatggacttaggtggcagcgacagaggtagagagaaaactgcactgccagggcaggggcagtaggaactaaaacaggtggctctgaaaggcattacagacgtagagacaatgctcttagcatataggggcgtgggaaaggtggggagctaaagagaacactaagattcttgctttcatggaaagatttcagaacgagaaaataagagtaggtactggtttaaaggagcgtgagggactaactcaggatgggatgatggggaatgctttatagaggaagtgacatttaagctagatattaaaatatgagcaggataagtagagtttcaccaaaaagtaaaaaagcattctaggcagagaaaacagcacatgcaaagacagaccatattacagttgaacaatggcatgcagttttagggaggtgcatcagatgataagaagggtaataagtaaggccaggggcggtggctcacgcctgtaatcccagcactttgggaggccaaggcaggtggatcatgaggtcaggagattgagaccatcctggccaacatggtgaaaccccgtctctactaaaaacacaaaaattagctgggtgtggtcacatgcctgtaatcccagctactcaggaggctgaggcaggagaatcatttgaacccaggaggtggaggttgcagtgagccgagatcatgccactgcactccagtctggtgtgctccagtcagagcaagactccatctcaaaaaaaaaaacaagggtaagtaatattaaattgtgaggcacttgcctcatactaagaaattgtaggtgatgagaagacaatcaaggtttctaaaggaagagggtaaaggggagcagcatgatcagggctatgtttcagaagggaaactgtataaagtacagactggaatggtaagacacaggaggaaggcaatagagcataatggctaagattacaaggtctgaacttaagacaacctaatacaaattctgggtttatagcttaatagctctgcaaccttgggcaagttatttactctctctgtgccctcattttccccagctgtaaaatgggaataataatagtactttatcaggcacaagccaccacacctggctattttatttttaatttttgtagagacaggatcttgctatgttgtccaagctggtctcgaactcctcaactaaagtgaagctcccaccttgtcctcccagagcactgggataacaggtatgagccactgtgcccagcccatagttcctaattacgcctttttgtattttattaatttatctttctcttactgccttaagttccatgaaatcacaaactgtgtgctcaccgctgaattcttagaaatcagcacaatggctggcacagcatgagtgcttgataaatacttcttgaatgaatgaaaggttccaaactatatattttaaatgaactctatttaaatgtaacctttatatagaaccccaggacacacagaagaagacagtttgaagtaagggatatttggagacttgttccctctgcttccccctggttcttaagtcagttctatagttctgtaaagctttacagaatgcagtgcaaaaaccattgtctgttacaagcaagaagtaatgtatgtctgaagtaaggcaatgacaataaagatgcaacaatagctttgagaactatttatgacaggccctgacaaccaattacagtaggccctctgtatccatgggttccacatgtgtggattcaaccaacctgagatgaaaaacattttrgggaaaaaaaagcatctgtactgaagatgtataaacttttttttcttgtcattattctaaacaatacaatgtaacaactatttacatagtatttacattgcattatataagtaatccaaggatgatttaaactatacgaaggacgtgtgaaggttatatgctaatattataccattttatatagagacttgagcatccaaggattttggtatctgtgtgaagtcctggaaccaatccccacagatgctgagggacaactgtataaatgaagaatgagaaaaggaaaattcttgaagcacctctaaatttcctagcttgagtgaacaaataaatgaacatgtgtgccaaaaagcaagataagaatgtaagagtggctgggcacggtggctcacgtttgtaatcccagcactttggcaggtcaaggcaggtggatcgcttgaggccaggagttcgagaccagcctggccaacatggtgaaaccctgtctccactaaaaatacaaaaaaattagccgggcacggtggcaggcacctgtaatcccagctacgagggaggctgaggcaggagaattgctcaaacccaggaggtggaggttgcagttagccaagatcacacaattgcaatccaccctgggaaacaagagcaaaactccatctcaaaaaaaaaaaaaatgtaagagtaacaataacaatttccattcatttgaacatagtatcacccctatcaagcaaatactattaataccctcaagttatagaataaatctttcacgatgttaagcaactgtcatgatcttcattagcaaagatcatgaggctaataagtagcagaattaagtttcaaatccaagactgtcccactccaagcccaaaatctaaaccgtcttgctatattggcaagcagtttgagagttaggtcttagacgtgagatatctactggatatacagttagaaataatcagtaactaatgaaaaatatgatttggggttagagataaggatctgggctccatttggaagactgaataaattcagaagagtgtctatgagaagatcatgcttgcttgtaaggcctgtaaatgggtgatgtacgcatttgcgattgaagtttgttgatttaccaaggtctctgccttgcatagatctagtgggcatcrgcattaagagaggaagtaaaaaactttaggagaaattccagatctctggggattcctgttaggacctttatattatttttgttttgggagaatttaacagaaagacagtgacaccaatgtcaacaaaaaaaaatgagacagcaaaggtgataaagagaatagatttggggatcatcattttctcttctgcttgagattccacagctctcaacaaaaatgactattatttgtgtatggctctttacaactaacaaagtgtttcccatttacaaggtatttcctgtttaccaataatgtcagatgaaccttacaacagctgtttaaggtgagggcattattattttcactttaccaaagaggaatgaagtccagaaaagttaagtttaccttgtctaaggtcatacagctaaaaagcaaccgggccacgatgtaaccacggttttctggctcctaatctggggctctttccagaagactcacctgagataacatgagccactcacttatgaaccaagagtcatcatccctatgtatagtttcactgtgtttaaaaataaaacaatagggggatagtgactgggaaggggctaatggtatgctggtaatgttctgtttcttgatgtaggtgctagtaacacaggtgtgttcaccttgtggaaagtccttgagctgtaaactttgtgtacttttctgtatatatgtcatactgtaattattaaataccaggcaagccaggtcaggaggcttgcacttgtaatcccaatggctcaggaggctgagatgggaggatcacttgagcccaggaattcaagaccagcctgggtgacaaagcaagacccccatctctcaaaaaaaaaaaaaattcagctgggcgcggaagcttacacctgtaatcttagcactttgagaggccgaggcagacagattacctgaggccaggagttcgagatcagcctgaccaacatggtaaaaccacatctctactaaaaatacacatacacacacacacacacacacacacacacacacaattagccaggtgtggtggtgcacgcctataatcccagctactcagaaggctgaggcacaagaattgcttgaacctggaaggtggaggctgcagtgagctgagatcataccagttcactccagcctgggtgacagagtgagactctgtctcaagagaaacaacaacaaataaaaaaaaattagccaggtatggtggcatgcctgaagtctcagctactcaggaggctaaggcaggaggatcacttgagctcaggagtttgaggcttcagtgagctacgattgtgccactgtaccccagcctgagtgacgcagcaagatcccatctctctttttttttttttgagttggagttttactcttgttgcccaggctagagtgcagtggtgtgatcttggctcattgcaacctccgccttccagtttcaagcgattctcctgcctcaacctgccaagtagctgggattccaggtgtctaccaccacccccagctaatttttgtatttttagtagggacagggttttactatgttggccaggctggtcttgaactcctcaccttgtgatccgcctgcctcagcctcccaaagtgctgggattactggcatgagccatcgcgcctgaccaagatcccatctctttaaaaaaaaaaaaaaaaaaaaaaaaaggcaagccaaactgataatcaaaactcaggaacactaagttggatgcgtcacattttttactcaatttctcaaacagtagctacatataggacatctaccagttatataaggatgtacaaaattcttgcacactcaaataacatatccacccaattgtcccaatccagactgtcttagtgatgtgaaagaatctgacaggactggaagtaacagaagcccaggaaagggcggagatttttgttaatgaaaacaaaaatggcattgaaaatggaactatcctacatcatcatcaatgatgagatatctcaatttcagagataacaaaaatgtgaaaaaaaaatggccagtgacaattggaagatactatcaattgtaaaatacaccccaatttcagtgttaaaatattaaaaaagcaaaaaaaaaaaaaagaaagaaagcattttaaaacaaaggaaatatattctaatctcaaaaggtagctcaattgtgggataacagatttgtgaagcacatctccttgtacaagctctttgttttagagataaggacactaaagccttcatttaagttattaaataaccttactaaattaaagctcacacatcagaaagttgataactacaattacaaagctggttccttcaatgctcgttctcctgccactacccagatgcctcctttaaatccaaaagaagatttacatattaattccatattaaaactctattttgactttcatatttctttacttcattaactcactaaaaaataataaaagttaacctttaaaaatcaattaaagctgggcgaggtggctcatgcctataatcccagcactttggaaggctgaggcaggtggatcacttgaggtcaggagttccagaccagcctggccaacatggtgaaaccccatctctactaaaaatacaaaaatcagttgggcatggtggcaggcgcctgtattcccagctacttgggaggctgaggcatgagaattgcttgaacccgggaggtggaggttgcagtgagccaagattgcaccactgtactccagcctaagaaacagagcgagacaccgtctcaaaaaaaaacaaaaaaaaacaaaaaacaaaaaaacaaaaaactaagctgggtgcggtggctcacgcctgtaatcccagcactttgggaggctgaggcaggtggatcgcctgagggcaggagtttgagaacagcctggccaacatagtgaaaccctgtctctattaaaaaaaaaaaaaaatagctaggcgtggtagcaggcgcctgtaatcccagctactagggaggctgaggcagaagaatcacttgaacccaggaggtggaggttgcagtgagccaagattgtgccactgcattacagcctgggcaacaagagcaaaactacatctcaaaaaaaaacataataataattaattaagatgaaacgatgtttaggaaacttcatttcttgcttatacaagtttgttttccttgttcttcaaaaccagtgaagcaatacaaagttagataaaagacaaaattagtaatctcccagcccctttccattcctctccaaggcctcctacaagatgagaaatggtaacatatttttgtgtcccccaaaaacataaatacaaatatattggaaagggttttgttgttctctgtttttagaaaactaggtttaaactttacacattgctctgcaacttatctcatctaacaatttatcaacatctccccaagcatcaataactaaaattctaactcatacttttaaaaagctacataaaagtccatataagggatatccataacgtgttcacatatttttctattgagggaatggctattttcagtgttaccatttcaaacaatgctgtaatgagtatccttgacgtatttcaagttaaagaaaaaaaactatttctacacacatactttccttgttgtcccatgttttgattactcctggtctcatcatcatccctacctcccttgctcagagaatcatcctcagggtccagtgtgatgacagagagcaaagtaacttggagaatgtcaagacaagacatgtgatagttactgttggtaaattggaaatggcctgtcttggctgcctctctcagtcacttgcacatgctatccccctcctccccttacatgtgctccctgttctggtctcagcagctgcttccaactcaactgatgtgagcacagctagctacyttgtcacactcctaaycctggcaagtgcagacaggcccaggagctctccaaacaattggaaaggagaaggaatacattatcactgtgaaataatataatacggaggtatctagagtaaaatgtaaaactccctcttcattaagcctcaacccacatttgccagtgacactccccagctcagaagtgaccactgttagaagtctgttgtacaaccttttggatttttcctaagcatgtacacatacaggtatatattcacatacaggtatgtgtgtttggtctacatatctgtaatcataccatataatatgttctgcaacttgcccttttcatgtamaaatttatttgacatgtttccataccagcaaaaaacagattcctcacatttttaattaattttttttgagacaaagtctcactctgtcacccaggctggagtgcagtggcaccatcatggctcactgcaacctcaaccacctgggctcaggtgatcctcccacctcagcctcctggtagctgggactaaaggtgcgcaccaccatacccagctaatttatttgtagagatgggatttcaccatgttgcccaaactgttctcaaactcctaggctcaaacaatccgcccaccttgtcctcccaaagtgctgggattacaggtgtgagctrtcatggctggcaattccttaaacttttaaaagcttraaaaaatcctatgtaagaatgtgccacaactttattttcccattttgctacatctggacatttaggttgttcacagtgttttgcatgtcaaagaatgctgtattgataacactggcagcacatctctaattttacacacaagctaatatttctctaggatatataccaataattagaattaatgggttgaaaagcttgtgtattttaaatgtcaacagatattcccaaattaccatctaaaactgtgtactagtttatagtctcaccaacagaggataaaaattcccatctacacccttctaccaatatattttatcaatatataagatagaatatattattgttttaatttatatcttatttccagaaaagttaaacatctcctcacatatgcaactgttcattcttatttcttatgaaaggtattaccattttgattttaaacatgagggttcagagatgctagagtgacacaaccagtaagtccagacatcaaagctgtttttttaacaatttcccatcaaaactaggcctctttctgtcaagtgtaattccccctaccagcagccagcaaactatggcctataagttagcagcccatattttgtaaatcaggttttactaaaacgtagccacgcccattcatttaagtattgtctatggctgcttttgttctccaatggcagaggtgagtagttacaaccacatggtctgcaaagcctaaaatatttactactggggtctaaacagaaacaataacttgcctaagcacagtgactcacacctgtaatcccagtgctttgggaggctgaaggtggtggactgcttgctgtttgagcccaggagttcgagaccaacctgggcaacatggcgagattccatctctacaaaaattagaaaaatagccagttgtggtggcatgcacctgtaatcccagatactcaggaggctgaggtgggaggactgcttgagcctgggaggccaaggccgtggtgaactgccattgtgccaccacattccagcctggaagacagagtgagactccatgtcgaaaaaacaaaacgcacacacacaaaaaaaacaagagttaaaaactaaagaaaagctcaggtctgggcacagtggctcatgcctgcaatcccagtacttaggaaggcttagcgagaccccatctctacaaaaaataaaaaaaattaggctaggcacggtagcccacacctgtaatcccagcattttgggaggccgaggcgggcggatcacgaggtcaggagaatcgagactgtcctggccaacatggtgaaaccccatctctactaaaaatacaaaaattagctggccgtggtggcgtgtgcctgtaatcccagctactcaggaggctgaggcaggagatcacttgaaccaaggagttggaggctgcagtgagccgagatcgtgccactgcactccagcctggcgacagagcaagactgtctaaaaaaatttaaaaaattaaaaattagccaggcacagtgctgtgtgcctgtagttccagctacttgggaggctgaggcaggaggaccccttgaaccaaggagttcgaggttgcagtgagctatgatcacaccacggcactccaaaatctgggtgatagagcaagaccctgtctcaaaacaaaaaaagaaaagcttctcagtggggattagttatggtctaattggccacagccagagcatggctatgttacagtgtgtggctcattttcaaataactttatatgcagtataggtctggtatataatcccaaaggaaagagcccaaaacactcaaatgaagtcaaaagacttatctttacttatgggttgcaacactaaaagattttctatgcactactcttcgtcttccttgtttcttttctttttttttttttttttttttttgagacagagcctcattctgttgcccaggctggagtgcagcggtacaatcacagtttaccacagcctcaacctcccaggctcaagcgatcctccttcctcagactcctgagtagctgggaccacaggcaggtaccaccacacctggctaatttttgtattttttgtagagacagggccttgtcatgttgcctaagctcatctcaaactcctgggctcaagtaatcctgcctctgcctcccaaagtgctgggattataggcatgagccaccatgcctggccccttatttaatttcatctggttcctactgtccttcaatgattttgacaatgtagttcctacccacacaccacaataatacaaaaccaaagcaaactccactatgtctgctgctaaacacccccaacaaacacacatacacatcacaccacaccacacaacacaacacaggtgtctccttcccttttgctagcagattcgctaggaagcagctgcacatttccagcaagtcgaacaaactgctgagagctagggcccctgaccattgtgggaaaggaaggccaattctcccctctagattgtacccttctgaagatcctggccatgaaagaagtcatttctccagagaattttaagccattcagttcctatacggcaggcaggaaaggtgtcatcctccccatatcatcagtggaggaactcagtgtaacttgtttcatttcctcttacttcaaaasgtcattttaagtaatagggtcatttaggtaatatcagtgatctttttaatttctcctcgcattctctcccaaattttggttttacaaaataatggttaaaaaaaaaaagctatcatactctccacgaaatttaacttaatctagaattttgaatgagaaattaataatcaaagaacagtgcattttaggccaggcgcggtggctcactcctgtaatcccagcactttgggaggccaaggcgagcagatcacctgaggtcaggagtttgagaccagcctggccaacatggtgaaaccccatctctacttaaaatacaaaaaagtagctgggtgtggtggtacgcacctgtaatcccagctacttgggaggctgaggcaggagaatcgcttgaacctgggaggtggaggttgcagtgagccgagatcgtgccattgcactccagactgggggacaagagtgagacttcgtctcaaaaaacaaacaaagaacagtgcattttcttacacaaataagcaggtattaagtggttctctggataggaatttggcaatacaaatcaaaattaatgcctataatcctagcactttgggaggccaaggtgggcggatcacctgaggtcaagagtttgaaaccagcctgaccaacatggagaaacccgtcttaaaaaaatacaaaattagctgggcgtggtggcacatgcctgtcatcctagctactcgggaggctgaggcaggagaatcacttgaacctggaacaggtggaggttgcagtgagctgagattgtgccattgcactccagcctgggcaacaagagcgaaactccatctcaaaaacaaaacaaaaccttgatatttgggccaggtgtggtggtggcacatgcccaaaatcccagcactttgggaggctgaggtgaaaggattgcttgagcccaggagttcaagaccagcctgggcaacatagtgagacctcatctctacaaaaaataaaaaattagccaggcatggtggtgcacacctgtggtcccagttactcgggaggctgatgtgagaggatcacttgaaccctgaaaggttgaggctgtggtgagctgtgatcataccactgcactctagcctgggtgacagagtgagaccctgtctcaaaacaaagaaacaaagaaacaaaaatgttcatatttggctgggtatggtggctcacacctgcactttgagaggccgaggcaggatgatctcttgaagtcaggagttcaagaccagcaatcttctcgcctcagcctcccaaagtgctggtgctaggatgatgggtgtgagccactgcacccagcctaagatagtaaattttgttacatacatcttaccaaaactcaaaaaaaaaaaaaaaaaaaaaaagctggctgggtacaatggttgaagcctgtcatcccagcactttgggaggccaaggtaggaggattgcttgagcccaggagttcaagaccagcctgggcaacacagtgagaccatgtctctacaaaaaatttaaaaattagccaggtgtggtggcatacacctatagtcccagctactcaggaggctaaggtgggaggatcacttgagtctgagcctgggaggctgaagccataataagctgtgatcataccactgcactctagcctgggcaacagagtgagatcttgtgtcaaaaaaaaaaaaaaaagaaacaaaaagaattaaaaaaaaaaaaatctcatgttctttcatcaaataattccaatcacagaaataaaagtttaggaaataatctgaaatacaaagatatatggacattaatagaattatttatcattctgaaaaactgaaggaaaactaaatatctaacaataacttaaattatggcaagaatatacatatgatgaaatcttatgcagtcacttaaaatgttttaaataagtttggctgggtacagtggctcacgtctataattccagcactttggaaggctgaggtgggatgattgcttaagcccaggagttcaagaccagcctgggcaacatagtagactccacttctacaaaaaataaaaataaaaaaaatagctgggcatgatggcatgcgcctgtagtycagctacttgggaagctaaagcgggaagatcacttgagcccaggaggtcaaggctgcagtgagctaggattgcaactgtaccactgcactccagcctgagtgacagagcaaggccccgtctctggggaaaaaaaaaaaagttttaaataattttaatgacatggggaaatactcaagaaakgttgaattttaaaagcaggatataggctgggtgcagtggcatatgcctgtaatcccagccctttgggaggccaaggcaggtgaatcgcttgggctcaggagttcaagaccagcctgggcaacatggtgaaaccctgcctctacaaaaaatacaaaaattagccgggcatggtggcatgcacctgtagtcctagctatttgggaggctgaggtaggaggattgcttgagcccagaaggttgaggctgcagtgagctgtgatcgtaccactgcactgaagcctgggtgagagagtgagaccctgtctcaaaacaaacaaacaaaaaaaaggcaggataaaactattatggtatggccccatttttgaaactatatatacaaatatttatagacagatagatatatcatatacatatttatccctctccccacatacttgtgagtttgtatatgtgtatgtatacgtgtaaggaagtataccaaataatgttcatttctgagttgtggaattatgggtgccttttactttcccccttaacacattatttttcatgttttctaaatagtaccatcatatacaattaggaaaaaattactttcatattgtttaatctagtaatctatttgtagatatgtatcataagaaaataaccaaaaacgtagacaaaaacttatgcataataatgttcatataaagatacacagaaaactattaataaataatggttacttctgcagggcagaattagggtaaagacttatttggggacttatttgttatatctattacaaaaatgatttgaaaaaaattccattattatttgaaaaaacctgaaagcatataaaaatcctatatgatagactattatgcagccactacaaatatttatgaagagtatatataaatttatataatgaaaaaatggtaaatggggaaaaaagcagaatataaaattttaggtaatatatgatctggaaattgcaaaaccagaaatatacaagcacaaaatactgaaagaaaataggctaaaataagaacagtagttttctccagatagtgggattacgggtgatttcagttttcttccttatacttctctgcgtttttcacatatcctagaatgaatatatactatttttcaatcaggcttaaaaaatgtttttggtttctgccctataatgaaaagcctgctccttgtgtgaaattttatccacaaaggattatcagtagtaagcaacccactagcaagaagactgttcataatgtatatgcctaagaaaatcatctttggtgggtcagtgagctcagtttaaagggacacagctctgaccacttcctgccttcttgcttttggagttgttttagtaaatataactgaggaatcaagttctcaaacatgagatgcctgacaaacttaatactgtactgtaagaaccaggaccaccaccttctctcaacctaacctctaagactttacacttaagaatagacaagaccgggccgggcgtggtggctcatgcctgtaatcccagcactttgggaggccgaggtgggcggattacctgaggtcaggagtttgagaccagcctgaccaacatggagaaaccccatctctactaaaaatacaaaaattagccgggcgtggtggcacatgcctgtattcccagctactcgggaggctgaggcaggagaatcgcttgaacccaggaggcgggggttgcggtgagccgagatcacgcctatagcctgggcaacaagagcgaaactctgctcaagaaaaaaaaaaaaaaagaatagacaggacctaaataacatagattgggtcatgttagtctgtaaatcaaaaacacttaacagctaattacatgaagaataaaatccaaatttcttagcataacgcttaaggttctctaagatccaaccctcaaatttccttcccagcctcatcttcagttcattccctaaaatatcctctacctcaggcacattttccccatacatgccaggcattttccaagctgtgtgcctttgcccatggtgtgacctccattaaatgccctgtctcctaaacctactgaactcctattcttcctttacaacctggctcaaatgccttctcccaaactctccttatcgcccccaccatcaggaacaattgttctttcctctatgtgctcccatattgcttgttcctctacaaacttaattacaatcctccctgggtggatgctagctgtaatacttgtttcattttactaaactcctggagggcagaaaccattttaaaatcatttccactccagcacactgcttgcacacagtaggtactaaatatgctgcctgagtaaatgacagccaattggcccttatctgaattctttcagtggtacagccagggatggcaaattgtcaaagctagtccctctaattgcaagttatacatatagcatgagtgaccagcagaaaatgccaagggcctgccactttaagaggactggcaagatgactatgtttacacaatcctaattaaaactaaagggcaatgagggaaagaagagaaatagggagattaagaggtgtggattctacaggtcacctcctcttcttagtgagcttgctaggcactaggctggaagatctgagctacaaagtagcctattttatctttggggtagcctgtaggatctaagtattgaaaagcaactaattaggccactttgtcctccagcaactggccctgctcttgggcattaacttccaactggtacacaaggctttttctctaaatgaatcccactgtaccaatcactaggagaatccctttaaaaaaggcttgaaattaataacagcaggaaacaaagtctctcaatcctctgaatcacaatatccacactgtccattttgatgaaattcacccccacctccttcaaacaataggtcctaccaaggaatgacttctctcaggaccaacatgtcctgtgattgtttttctggagcaagcttccagtgcctgcttctcattaaatagctacttaatgtctgatcacccagctgtgactataagtagagagtaaagtaactataatttaggaagtaaaaaagaaattccactcctaccccaagtccagtagtcaaacagcttagaatagacatttccctacctcaaaccttcttaggcttatccaattttcagatctagaatttttagcatctcttaactctttcaatataaaaatgaggaaaacaatgtytagagtaagaaagagaattgcaaatgattatacagtaacttagtcacagaatcttttgaccaggctgtctaacacctcatttaactgatgagttttcaagaccactgtttccaggaacaggttacagggcactacaatataatcagcttaatttgcatatattcaagataacagcccctaggcttgaccccttcaccatcttcctgcctaccttttttcaaacccacaactgctaacaacaacaaaaaaatcaatgtagtgatttaatacatcatttctgcctaaaaaaagactggagctaccaaaccatctgcttcagcctcaccacctgggattcatcttgattgatttgggtgtgttggtgggcagtggctgccacagcctgaagaactcttccaactctttctgggggtcttctggagatgggactgcaatggctcctcagctgcagtttcctatagagcaacatgttgaaacacacttgttccctcaacacacttgtgtttcagccctcaacacacttgtgatttgggaggagtaccaggagaaagaccagtttttggcagggcgcggtggctcacgcctgtaatcctagcactttgggcggccaaggcgggtggatcgcttgaggtcaggagttcaagaccagcctgaccaacatggtgaaaccctgtctctactaaaaatacaaaaaattagctgggcatggtggcacatgcctgtaatcatagctactagggaggctgaggcaggagaatcgcttgaacccgagaggtggaggttgcagtgagctgagatcccgccattgcactccagtctgggtgacagagagagaccctgtctggraaaaaaaaagaaaagaaaggccagttttctccattatctagtcaccccaacctataagcaagcatatgcacagtcactataaaggaaagtgacttgttttccagcagacatttctaatcttattaaatcaaatgaaaactgcaatcaaaatactctccttaggaagttatttacttattctaacaaaacacttctttgggagctgcctttaaagtctactccatgtgagacaaacagaaaaattcggtgttactgttttatagtcacacctcatccttcaccaaaaaaggtattgccttgcatgaatctttggctcacggcatcttctggctgtttctaaaaattgaatccaccaagctaagagtaaagatttgctacctctgaggatattcaaaagattggctcagaggcagtctgaggcaatgacaccatcaccaaaggaaatctaaaggctgagaacacaattactttgaaggggtcaaacttaaaaacattctaattgccccataattacaatcaagggggcaagacatgtacaatatctgtcacatttgttcaactattatatcactttataattacacattayataatgataaattttggccctggaagaaatcttcaagatcatataatcctaactgtccctttttacatatgagaaaagttcagtccattgaggttaggcaatttgtccctggtcacacatctggttagcaacagtcaggatgagaaacccagacacccaaactcccagcataatgcacccacacatacttatgtatacagctcctcctcccctgcttctcacttccttcactcccctgatcaaaagggacagaaataacttgggacactaaagcacaccaagaatggttctgaaacccagtagcagagaaatgatggcttaaaaaccaggacttctctgcagtggcctcaatggccaatgtttagtgtctggctcacaagagttctgggcaatctacctcagagcaagggccaatgaaaacctctggacaccaccctcccacagttagaaaaatatctttattaaacctctctgctctcctcctacagtaacctgtttgcctcaaataattgaaagacaaagacaatcactttgaagaatctgggtcagggaaaaagtaaatggtagagatcctgctcaggacaaagctgacctatsaaaaactagagggcagaaaccattttgacttacctcctggtggaagcctccacacactagaacagggtgatctccagcagtctggcttagaattagtttccacctagggaaggggcaaagggacaggaatgattattcattcccctaacccacccactcttagtgagctcagcctcacattatcctgggcaaccccagcgttctgtggatcagacagcaagcagaagggaagccatgcaggccaggtcaacggggtgagtcagtggcagagcaggaagagtcactggggcagaaattctggccttctgtggcaagactgccaagccacacccacacttggtcagcactgtgaaggccctgccctgttaggatttcagtctttaagccagaaaacttcttcctcaggaggccccacaccactctcattttcaagtgtctctcctcctgctcaaaaatcttccagttttcttctccctaaagcatcatatctaaattctttggcttaactttccaaatcctccattatatggcctcaagtcatttattcaaccttatttcccactattctacagaatatactctgaattgatcaagccagtcttcccacttctctctgcgtgagccaagccttttctcatttccctgctttcaattatccaggagtggtaaattcaaacatcttcaggggtcaggcaggtaacagaaacaaattatccaggcaaggcccagtggctcacagcggtaatcccagcactttgggaagccaaggtgggcagatcgcttgagctcaggagttccagaccaacctgggcaacatagtaaaactccgtctctacaaaaatacaaaaaattagctaggtgtggtggagtgtgcctgggtcccacccacttgggaggctgcagtgagctgagaccgtgccactggactccagcctgggcaacagagcgaaaccacgtatccaaacaaaacaaaatgaatgatccagtggggcacatggcagatctaggaaacgctgcacccccctaaaggcattcaaatattttaattcaaatatttatgtagtgtctcactgtgagcatcacgataaccttttaaatagttattaatactctatcttgcaaatgagaaaacttccccaaggttaggtaactggcaaaatgctgggcacagtctctagacctgtctgatgccaaagcaagagctctacaccattaggcttctagcagtgcaaacaccatggaagatacagaaccctcaaagtcacttttcatgatacacaaccttaatagtaggatgggaagcccaaatcacagcttatctaaccatatcccaactgcctccaattctgttcattttccaaaccccatctttctgccaaagtatttcattcctagttatccaagtcctactgaattccttcttctgtaaattcctatagggtttatagattagacaacacaaataagtgctaaattatatactgtcttgcaaaatcagatactgcttctatgtattttagtgtcagcctcatcaatcaaactattgtattaatctatatagttcttctaccaaaaatgcctaacctgaatctaatcaagaagaatcagacaaatgctatgaaagacaaaaaggcattcagattaaaaaagaactgttcaaagttaaagcagactaaagacatgatagtcatgacaactaagtgcataaatacatgcatgatccttcaatgaatcctgaattttaaaaaactcaataaaagacatcactgggaaaagatgagaaatctgaacaagtattatatactggatgtattgaatcaatgttaagtttcctgagtgttaatagtactgtagttatataggaagatacctttttcttaggaaatacttgctgaaatagggattaaataacatgatatttacatctaacagtcaaaaagattcagaaaatgaaggayaaatagacagcaaatttggcaaaatgttaatagtgactctaaatgagaagtatataagtatttgttacattattttgcaaaatatctataggtttgaaaattttcaaaataaaataatttagtaaggagggaaatcctgtattatatacttttttatatactcagctctgtgacagatataataggcactcattactttaggtatctgctcactacctaaggaaactgggcatttggaggtcarcaatcagacagagtccactttgctgcagctcatgaggggtatagtaggaaattcttagggaataagaggtttctccaaaactcacattgtcacaccacaggaaatctagaaaagcaggcaattacctcactcctcattgaggccatcacagaagtacaggcactgaacaaatgcccactcgctaggcagaatgcagctgctgcccacacgttagtacccagtggtaaggtggatacaatgtgacctcagaggaccaagagttgaggtcacattgcatccaccttgccaccgggtaccaaaaatttgacaatctgcaaaacaagtgtctctggccagtcacaggaaggcactcaagtatcaaataaacatgcctgaaatatatgcagtctttcctcctcaccagataaaccagtcctcagctgcaataaggcagaagaaatctgcaaggctgaatcactggtatttcctgtgcagacttcaaagaaactggcccttcaataggacagaaagggcaggcgacacagctgccaacagaggcctcaacccaggagcatgctatgcaataatgccttctctcccttctacagccatcagatacctcatttttacttctgccaaatggccccttattaccgcgactgattacctaatagccaaccctttaccttggttctctcctcccctcaatgagacccaagatactggcctttctagacagctcctcctccaatttgccagaggaattgtcaaaactattcccctggccaggcrcggtggctcacgcctgtaatcccagcactttgggaggccaaggcgggcggatcacactgtcaggagatagagaccacggtgaaaccccgtctctactaaagatacaaaaaattagcygggcgcggtggcgggtgcctgtagtcccagctactcgggaggggaggctgaggcaggagaatggcgtgaacctgggaggcggagcttgcagtgagccgagatcgcgccactgcactcaagcctgggtgacacagagcgagactccgtctcaaaaaaaaaaaaaaaaaaaagctgcctaggccaggcacaatggcttacacccataaacctagcactttgcgaggccgaggcaggaggattgcttgagctcaggtgttcaagactagcctgagcaacacagcaagaccttgtctctactaaaaatcaaaaaaattagccgggtgtagtcccagctacactacttaggaggctgaggtgggaagacagccactgcactccagcctgggtgacagagcgagaccctgtctcaaaaaaaaaaaaaaaaaagttgcccacagtaggaggtagaggagaggccattattaagcacactctcagtaaaccatgaatctgacagagctacccaaaacatcaatgcagtcttaagctgcattagtagaagatgactctatgccccacctttgaagagcaaagttagaggacttgcagaggaagaacaccaatgaccatggcaaagggtctagaagtatatcatttcaaatatggaggaagaactacacacttttagccaggggagaacaagaaaacttttttcaaatatacgcatagctttcacatagatgaggagaaagacttatgagtccactataagaatacaaaaccagaactaatgagtggaagttacaggaagactgattttggtttgccacagggaagaaatttcagcatgttgtagaagttcagaatgtgggatgtagaacccagaatgcttggattaggatgtcaactccaccacttataaactgtgtggctttggggagattaatctacctgtgcctcagttgccttccctgtaaaagagaatagtaataatagaacttagctcacagagctttaagaagtagcttccgaggctggctgcggtggatcaggcctgtaatcccagcactttgggaggctgaggcaggtggatcacctgaggtcaggagttcaagaccagactggccaacatggggaaacccgtctctactaaaaatacaaaaaaaattagctaggcttggtggcgcatgcctgtaatcccagctactcaggaggataaggcaggagaatcgcttgaacccaggaggcagaggttgcagtgagccaagatcacgccattgcactccagcctgggcaccaggagcgaaactccatctcaaaaaaaattaaccagacggtagtggtgtgcgcctgtaatcccagttactcgggaggctgaggcaggagaatcatttgaacctgggaggtggaagttgcagtgagcagaaatcacaccactgtactccagtctgggtgatagagagaggctccatctcaaaaaaaataaaaagaagtagtttctgtaaagtacttagaacagtgcctagttcacaatatacgctggaaaaaaaatgttacctattgctattactaaatgttgatacaacagaccaggctgggtgtggtggtttgtgcttgtaatcccagcactttgagagaactgcttgagctcaagagtttgagaccagcctgggcaacatagtgagacctcgtctctactaaaaataaaaagagttgccaggcacagtggcgtgcacttgtagttccagctactcagcaggctgaggtgggaggatagcttgagtccaggagatcgaggctgcagtgagctatgatgacgccactgcactccagccagagtgacagagcaagactctgtctcaaaataacaaacaggctgggtgcaatggctcacgcctgtaatcccagcactttgggaggctgaggcgggtggatcacctgaggtcaggagttcgagaccagcctgggcaacatggtcaaaccctgtctctactaaaaatacaaaaattagctggttgcagtggcacgtgcctgtaatcccagctacttgggaggctgagacaggagaatcacttgagcccgagaggcggaggttgcagtgagccaagactgtgcaattgcactccagcctgggcgacagagtgagactccatctcaaaataaataaataaataaataaataaataaaataaaaataatatacaatacaaaaaacagaccagataacctgaagcccttcctactaaatatgcctagaagtgctcagaaaaatataataaacatccttctagactgtgccagctattaaggtattgtctctcagctccaaatctaccctgttatgctccgctttgtgatgctggggcctggactccactaaaccccatttcacatttgccagctggatccctgtcaacagggggtgctaaggggaaaacagaagacaagagaaggctacaagggacttcctccttcttgtagcctggtgtttcttgacaacagaagttggttcttcccagttgcyttctaaactcccaaaaccagcctcctgcccctcaaaggcaccagcatcagctaagtaaggctcaacagaagccagctcctccaggttcctcctataagggcctgagaaaccagcagcaccaggtaacaccctctccagagaatctgggtacagctattccagatccctctagacttctaggttctggtagccccaaccttcctccctttgtttttcagtcctggatgagaaaaattctttatgcagttattatattgaagttactttaatattccctttctgctttttcagccctccaccaagggtttaaatcaatctcctttatggagttcactctattgtgtggtttctgttttgctgattggatctgaactgacatatagataaactgagctctcaagaaagtaagaaaaatccccaggaaccagaaacaaattagtgaggaggattagcgagctgatgacatagctgtcctagccgtgtatggaatttgtaacaccctcataggttcagaagacagatcttgagtccacaaaaggcactgagatccctgtgcagaggctgagattcttaagtttatactcagtaagataatagactaggaaaaaaaatctgtccagagagaaataaaaaacttgccttgctcacctagtgagaaaggagggaaaaaccgtctaggaattcaaaacaggctgggtgaagtggctcacgccagtaatcccagcacattgggaggctgaggtgggtggattgcttgagcccaggagttcgagaccagcccgggcaacatggcaaaaccctgtctctacagaaaatataaaaatttgccgggtatggtggtgtgcacctgtagtcccagctacttgggaggctgaggtgggcggactgcttgagcccaggaggcagaggttgcagtgagccaagatcctgcaactgcactccaacctgggcaacaaagccagacagatcctatctcaaaaaataaaataaaataaaataaaattctaggaagcagacattaatatgtagtgaaaaacaaacaaacgatcagtggttcctggtatcagggtgaaaggaaaaacggactgtaaagaagtatgagagccgggcacggtggctcacgcctgtaatcccagcactttgggaggccgaggagggcagattacctgaggttggcagttcaagatcagcctgaccaacatggtgaaaccccatttctattaaaaatacaaaattagctgggcatggtggtgcatgcctgtaatcccagctactcaggaggctgaggcaggagaatcgcttgaacccaggaggcagaggttgcagggagccgagattgcaccactggactccagcctggagaataagagtaaaatccatcttaaaaaaaaaaaagcatgagaaatcttttgggggtgagagaaatcctctgtatcttgattatggctgctgtttacaggtgtagacatctgccaaaactcaactttcttgaaaattattacagacacaaaattgaaaacatgagacaaaaacaagatcacgaaaaacaagcagatttgaaaatgaaccaaagagcacttctaataaatgaaaaagttagctaataaaaataagaattcaaaaaacaaattagacctagctgaagagtaaactagtatactagaagatagatataaggaaattatccagaagttaacacagaaagatagaaatggaaattatgaaagaaagaataagatgtagacgacagaatgaggaagttcaacatamgttacgcatgagatctgagagaggtaaagaggtaatgattgggaatttttacacaattagtgaaaagatatgaaatttcagattaaggaattactatatgcccccagtatatagtgatttaagaaaattaaattcacaccatgtaatggaagtacagaacacaaatgacagcaaagaagatcttaaaaacaaacagaaagaaagacaggttacccacaataaaataagttaatttgcaagcatagttctcaagagtaacaacaaaaagccagaatttcaatgaaaaaacactttcaaagtgctaagagacaataattggaagcctagtacccagctaaactaccaatcaagactgaaagtgagctgggcacagtggctcatgcctataatcccagcactctgagaggccgaggcgggaggatcacaaggtcaggggatcgagaccatcatggctaacacaatgaaaccctgtctctactaaaaatacaaaaaattagccaggcgtggttgcgggcgcctgtagtcccagctactcgggaggctgaggcaggagaatggtgtgaacctgggaggcggagcttgcagtgagccgagactgtgccactgcactccagcctgggcaacagagtgagactccatctcaaaaaaaaaaaaaaaacaaaaaactgaaagtgaaataaagattttttaaatgaagacagtgtttaccactaacagattcccactggacaaacatctgaaggatgtatgtatctatgcaataaaaaaggaaggaataaaatgcaaggaaaaatagtgaaaaagcaaacagtagacatacatgggtaaaatgaaataatcactaacaatacaaaacaataaacatattttaattgtgttggggtctcactctgttgcccaggctagctaagaactcctgggctcaagccattctcccgcctgctcctcctgcctcagcctccagagtagttgggatgacagggcaagccaccatgcccagctacaaaataataattatcaattagaattgttcarcttagagatggattgactttgggaatgatctcattctagaaagtactcattttgagtctggacaacaccttttggtatgtttagtgtacactgggtaagaggctaaattaaatgaccacaccatatattaggttaatgcaaaagtaactgtggtttttgccattactttcaatggcaataactgcaattacttttgcacaaacctaatatcttctgatcatagttttatcaattagacacagctgtccaaacagcccctgatcagctctgttcagccacctgagcagggctttgccctcatcctaaaagttctagaattcaagtcttatttcaaggcattcttcccacttccatgttccacatgtaaaaaagaattctacgtttcttaacgagctttcaggtaagatctttaagcttttggaatgtaccgcttttcgctgtgaactaagagcttagacattacaattagtcatcccttgctagaacttaggctacgaaaagaatactttggaagctttcacaaaaaagtatgtggttcttcctctaaagaagaaaataccacacagaaagagggactgaggaaacataaacccatctgtgctgacagaaagctaccttacatgatcctcatgttcgccccaggttcccatatattcacagcagtaaagatctccacaaagcagagaggcccaactcccttaccattaaagctttaacgaccagacaacccagaagtttggaaacatagaaccaggcaacagatactagagagagggaattatgtattaaagcaagaaaatatcatcacgttttcaagagggagtgccattccagtaaagaggacagcttaatactgaggttcaaatgccactaaatgaaaacgggaaagcgaaattcctgtgccctttcagcccaagaaattattccaaagcatacatttattcccattacatgtcgcaaatcctgcctagccattaggatacagtgacgaaaaagtctctcgttatctagaagggcagacaaacacgcagacttttaaaataccagatggcaggccgggcgtgatggctcacgcctgtaatcccaagcactttgggaagccgaggcgggcggatcacgaggtcaagagttcaagaccggcctggccaagatggtgaaaccctgtgtctactaaaaatacaaaagttagccgggtgtggtagcgggcgcctgtaatcccagctactcgggaggctgaggcagggaactgtttgaacccgggtggcagaggttgcagtgagccgagatcgcgccactgcactccggcctgggcgatagggcgagactccgtctcaaaaaaaaaaaaaaatgacaagtgctaactcagaggtaagcaaaagagagtacccagaggcggcagcatcaacccagtgggctcccgcccacccacaatcttcacacagtcacaccacttatagtcataaatttgtactctccgaggtgcgtgtatgaaacatgttatctgtgagagtccatggatgaaaaacaaaaacaaacaaaaattaaaaaaaaaaaaaaaaaagacttaacctgttttgaccaggacaaccaccccaggaagtaggtaaggcaggtaaggtcattgtttacatatatgaaaagtgaggctcaaaatacactgaccagtccaagacaacgcgcgcccccacamagcaccttccccgtccccatttatgcccaacccataaacccaaagtagagccaacctcgcactggctacgtaacccgggccaagctaaacattataaacctcaggctccccatctttaaagtataacaggtggttagaagattaaaaagataaacatttggcaggtcattgtggacggtgtagctcagaaaatgctgactactgcactaccataactactgctattgttaacgataaaaggcaaagactttccaggacccgacccctcgcttacaagcctttcgggaacttgccctatacccccgaccccagtcaccttcagatttaattccacagacacgcccccaaacagaccctcccctttaaggcaccccccccccccccggctcctccctctcaggcgcctctcctcacaaaccttacccccatagattctgccctttcggactcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcgggtgagtcgggcgggaaaacaggaaacccgttctaggggacaagagatctatggagaagggaggggcactcacagaacgactaagaaccttcctgctcggggatctgagatttcccccaccgaccctcatcacctttcacrgcgaacaagatacaacactcacatgggacagactgggcgagggggagcagagggagggataggcgttgagatatayatccatacagatttggggatgcttaagaaccacccccagggccgggagcggtggctcacgcctgtaatcccaacactgggagaccaaggcgggcggaccacttaaggccaggagttcgagaccagcctgagaaacatggcgaaccctgtctctaccaaaaacataaaaaaattagccgggcttggtggcgcgctccagtggccccagctactagggaggctgaggtagaaggatcgcttgagcccggagattgaagctgcagtgagccgtgatcacgcaactacactccagcctgggctatagagcgatacctccatctcaaaacaaaacaaaacgaaacaaaacaaaaacaaaacaaaacaacgaaccccgcccccaacgcaaacataaagctcccaaaatcggatgcttcaagttccaggcataacctgggagatcagaaacgccctcagaaatggggttggttttcctctgaggaactgagaccctcttccaagacatgcggttagcattagattgagtaaatcgcagtcgctaccctaattctagagatgtaggaaacttcctggggcgtgaagtgcctcattccttcttcttccaaggagtaaaaccccttctcaatctgtccccagattcccttttctccccacaccttctccgtggtccgctactcaaagctctacagttagagcttcattttttttagtactcacgacagatctattacatttagtaacctacccagtgctttcacagtctctcttttgatactcttaacagctctgtgagtcaaggatatttatcttcatttcacagattggaaaactgaaacccagagaaaagggacttgcccaaggccacacaccaaattagtgacagagctagaactagactccagttctccgacttccagctaagtctctttagcttcagcctactgcctctatagcggaaggacttgttccaaggaacaagttaaactgccccagggaaaaggaacctgtgtggcctactttgtattatttacacttcagctggaatgaatttcagatcctcccctgaaacttttaatggggaaaaggaactagagagactaagacaatgagacttgaacatttttaactaaacaggaaacagaagggctaacacagcacccatgtctgaagtgaccatgattagctggtttctagctggtgactagctggccctgactggtccacttactaccttaaagttctcccaggtttggtcctacgccctcttgccactgcactctatattctcttcttgggtacccctccacacccacaacttcattttccacctgtatgcaaatgtacacaagtgtgtatctcaagcccagccctcatctctaagctccagatctatatagccaattgcctcaacatctcctttaggatacctcaaaggcaacccaaactctacatttctgaaattgaaacaatctctgtgtatcccaaccttttcctccaagcctggatctcttccagtgctcctacctttatccacaatatacccaagcccaaaacccaagttagtacctcttccatttacttaatacctcttccatttcccatctatcactaagtcttatcagctttacttcctgaatatcttttatataggtcctagctaccatcacatccttcctgccttccctcccagccatatttgcgcactgcaaccagagtgatccttcaaaatgcaaagctgatactrttcactctctaccccacccccaattttttttttttctttttgagacagagtttcgctcttgctgcccaggctggagtgcaatggcgcaatctcggctcacagcaacctccacctcccggtttcaagcaattctcctgtctcagcctcccaggtaactgggattacaggcatgcgccaccacacccggctaattttatatttttagtagagacggggtttctccatgttggtcaggctggtctcgaactcccgacctcaggtgatctgcccaccttggcctcccaaagtgctgagattacaggcgtgagccgccacgcccagccagcccccatttaatattaatactatgtggtttcctattgctcccatctctccagcctccagtctaaccatacatattcatccttctctccccttcagttatataacctttaaggtcttcaaaatttccaagtacccttccaccatagaacctttgcatatagcagtcacatctgcctggaatgctcattccacaccaccccctaccccataagttaatttgtacttatcctttagatttctctcagtcacttcttcaggaatgtcttcctgtagactgttcagaccaggtcagatccctcaattacagcaacctcatggccctctcctttgtagtrttatttagttgcaatttttaatgtgtttgttaagcacctactacttgccggcactatgagatacaactgtaagaaaaaatatggtttctgccctgctggtgtttatggacatacagatagtaagcagataattayagtgttacgagtgctaccatggcaatcatagcactacaattacagatttgaggataaaggtagacttctcagaaaagttgaaacctgatctgagccctgaaataagaattagcaaagcaaaaggaggagagaaaaactatattccaagcagacagagctggaaggagacactgttccacttagaggcccagtggcaggtgcagggaacttatggtgagtggttgcatttggctagactgcagaattggagttgaggatgagatggtagtagaggggggtggacaggagccaggttgaatcttggtcctccttttggcacctgggaatataacctcccagaatatattagattatgtggcagatttttcttctttttcttttgacagggtctcgctctgttgcccagactggagtgcagtggcacagtcatagctcactgcagcctcgaactcctgggcttgagccatactcctacctcagcttcccaagtagctgggactataggcgtgagctgccatgcctggctaaatatgtggcagatttttcatagcagcctttgattttttttccaccatcagtccatcatcagaaactctcgggccaggctgttgaatctcctatcagatttatgtgattattcctcaaagcttcctgtgttatcatgttgcaacttgcctgagagagggcaggaataggctagcaacaaatcaaattccaaatgttagtaatttcccaaaactgaaaacagttttctgtcaacttgggattggttaaataaattaagtgaataacattaaagtacgatayatagtataaaatactttgcaactattaaaaagggtaatagtctacaacaatttgaaaattaaaaaataggtttacaaaggaatattgtttatttaaaaatatacataatctaggctgggcacagtggcttacacctgtaatcccagcactttgggaggccaaggtgagtgaatagcttgagcccaggagtttgagaccagcctaagcaacatggcaaaactgtgtctctacaaaaaatacaaaaattagcagggtgtggtgacgtgtgcctgtagtcccagctactcaggaagctaaggtggtgggattgcctcagcccaggaggcagaggttgcagtgagctgaggtagcaccattgcactccagcctgcacaacagagcgagaccttgtctcaaaaaaaaaaaaaaaaaagaaaaccgtgtgtgtgtgtgtgtgtgtgtgtgtgtgtgtgtgtgtgtgtgtaaaaccttattagctatacattctaggttatattcccaaactgttaatggagattcaaactttgagtttctatttgatgtacttcttgtcatttcactttattcatctatcatattagcttttacagttaaaaaacaaaacagttaaagatactgtcaatttggaaatgagaaattccagttccgaaacaaggcaggtatgcccctaaccctgtcattcatcaagttagtcagtctggacagatgaaggtgctggcatctgattacctcctggtcataagccagaatagcagatgggaaagactgactccaaaaacacagccacaggagtaagcatggcagcatcaacactttgtcagttctccccagcagtcaagctctctatgtgacaccttgaagactccattaattccttcatttcttctttcatttttccattgtccatccattttcatttgtccatcaaacctttagtgaatatggattttttttttttttttggccaggctcaatgcagggtaatgatgagaagggagaaagaagtctgagtcttgtccctgtcctcaagcttatagggagtaaacaaagttggttataatgaaattaacagagaatacaactgcttccatttattgagcacctgatgccagatgtacaatagttctcaaggtagggtttgtctccatttcacagatgagtaaacaagctgtaataaaattttgtttgaagtacagtgggggcatgcagaagttagctattgccgtgtaataaaccatcccaaaacacagtggcttaagataataaacatttattattgcttctaagtcttagagtcagctggagggttcttctgctttggctgggcttactcatgtgtcggcagtcatctgtgggttgggtgactctcctgatcttgactgggggtaggctgactgtgggctagtctaggatggcttcagctggtatctctggctctttygcatgtctctcacctacacatctcataaccctccagctgatcagccatgttctcatggcactggcaaagagcaagagggcaggcctcctttaaagcttctgtttgcttcatgtttatcgacatctcattggctaaaacaagtcacatgtctggtcccagcatcagagtgagatgggactacaatgttataggcaaaaagagatggatacaggggagaccatgaatagggatcatcaaaacaatcagcctaacacaggacacattaaccaattttatctggaaaagaaaggctttatagaagaggctacactagaactgagtgttgaaacatgagagagtattcactaagtgggcagctgttacttggaactggatgcaggctggtttaccacaatcaatagaaactcagcaggtctttctgtgctcatgacagggttctattatttgtatcttggcttcatttcttctggtcaggcacagagcagcaagcacwcaacaaatgtttgctgaattgaattgaatatcttactgtgaacaaggtgtggactgaaacagctgaacctgggaaccaattgttagaaagaacagcttagcatcaactcttctgaaacagaaatcctcagaattggcagtttctcattcattcatcccacaaacattttgagtgcctgttgtaaacctggttctatgttggataatgaataagatgcgatactagctcacagcctgggctacagcttaaatgcagaaggctaaaaatttaaccagcttcttggggctccatttttaatactaatycattcagaaaatgcaacaggagctggtgctacacaaaatcagaagtctttaggaactgcactgggttgctctgtcaagaaaactaacagtaaaaatctgcccttaagtattttaagttaaaatccatgttcagtggtgcataactctggggtaccaacccagtatttactttgagaaaagtatccaatcttgctcaaaggtatcaaatctgytgtaggtgctgaagtgggatgagcttctrtctaagctaggttcctctagttctgtagtagacagccaggttcctctatttttacaaaagaataatgtgttctttgttgtctgcctgtagatttaatatctaaaagattcaagtctccctaattgacaatccatgcccatgggaccagttcataacagaattaagctgtgaagtgactcaatctgtcacctccccaaagctcagctggtactgctattttttcagaacaagacattcattttcctctaaacctactaaacttgatccatgtatatgttaaattgccaaaaaaggaatttacatgaactgtattaggcttaaactgaattataagatatcaggtccttggtttttaacagaaattcttttttttttttttttttttttttttttcctgagacagggtctacagggtcttgctctgtcgcccaggctggagtgcagtggcacaattatagctcactgcaacctccaacttctaggctcaagcaatccaactgcctcagcctcccgagtaataaattccattttaaagttgtttgccaatttcattgtctctgcaaactaatttatcctttgaatccaatgatgagaactgcaatcccaaggtttctctttttgctttggctgccaggaatttcagagctaaatgtaggcttagattcttaaagtgcctggcacatctctctcttcctgtaatctagtttctgatctttctcttccatttttaactttctaatctgcactgtccagtatggtagccactagtcacgtacatttgacaggtaggctagtccaaattgggatgtgctgtaagtgtaaaatatctcagtaagttttaatattgattacatattgaatgattttttgatatattgggtaaaattaagttattaaaattaatttcaccacttcattttacttattttggctactagaaaattttaaattatatatatggcttgcatttgtgacattatatttctagtggatggcactattctgcaaatcatctgttttatgactgtgttattattgtaaacctgaaatccttttggaaagcaggtgaagtaatacaaataataatacaaaggtggcagcagtggatggaatgagaaaggggaggtcgactgggrcaagttcttgtccttatccttgtcaatttgtcttttgcttgtgtgattcacatacaaaccccttggtaaagtgtgttgtcagctctcttcatcccaggtgagtagtattctcatggctctcccttgtctccagaaaaacctcagctttactttagctaacaaattggaaacgatctgataagacaattcacaccacattgcaagtgactgataacaacattgtgttcatccctgtcagggagtatttccattttaaccggaaacaatccctgaacccacaggaatgaatgcctaatggtggagtttcagccatcagtgacaggtgagtgagaggtagactctggttttgtgtgtgtgtatgtttatatgtgtatggctacattcaggatagggctgaaagtagggtatttggatggaaaggtaatggggctggcagagaagccaagcggagaaggtggcaaatccccagctgggccagactgagaggggtggtgagacaccaaccagatgcggtgcaggccctcaaggatttgttaagcaatagaatagcccagttgatgtcamcagagggtgggtatcaagacagtctccacagtaactactgtagagtaacagaaaaggtctcagagtaggattcaggagattatgactgcagtctacaactgactcactggcttaactctgggcaagtccttttaccccttgggtttcagtttcttcatctggcattttccagacaaagaaatgggtgttcgattctcaaatgagttctaagagatgtgaaggtgctctgagaagtagaaagtgctctatacatgcaaggatgcaaggaagagtgatttcatatcttaaaatggaaatacagccaggcaggcctagagtagtagaggacagaaagcagggatggaggactatggggaaacctgaaagccggtgtacttgaaacactggtctttctctgtcctcccaggctgaacccagactcccagggcacctgcttgcacctttgaatgatggcctgaactatgaacaaacgggactatatgaacacttcggtacaggagccccctcttgactactccttcagaagcatccacgtcattcaaggtcagcccccagagcacagtactccactcactaaggcagcaggcccagtgtggtccctaggaagaaaccataatctacttaaaagcctaaagagattcttcccatatgcttgcagatgtgttgttactgtcttttggagggtaggggagagtgagaggtttttttctgtctttttgtttgttttgattttgccccgatacagccccaggagatcctaagaacatgtgcccctgtttgttttttttaagcagcaaatctgaaaggaaacagggggctatcacagtagttgatcatctttaaaagaagccaggctacagcaggaaagtcaagtggaagaaaactgggaagccagtctatcagccaatagttttattctcctgtttttacctgaagagaggaggaaaacacaggctcctgtggagtcccagcaagtaggcaaaacctttctcctctgtctgcagacacaagcctaatctgactggccaaacatgaggggtcttatctacaaactggcatatttccagtttaaatacttactgacaaatttcttacactcattccagccaaatccaagtttattccatcatcacctacacttattgcaggttccaacactgtccacactcgctcccattttgccattcaatgtctttgtaaatgggtagctagtcccttcaggagggaacatagggaggctgtcagccatgtcatattcccaatgagtcatccgttcttcctagggaagttctgccatccctggcttttgttatctggtctttcattaaagcatcagtccatctgtcctcacagaatacacgttaacatccactatctcagaactattatttggctttagtcttctctcaggcaactggtagccactgcctttaagctcgggaagctggcaaatagcaccagtcttagattgggtttagggtctacttgggttatcatcagccacagtggtaactcacgtttgttctctcacgagcacacagccacctgctgtgatctttattgtgcactgcatcacttctgatgtaatccatgtttcacaaggggttttagctgcaatagtaactatctctaagacaggtgcaatgacagaggtgggaaggaagtatacctcctacctatcatgggaatttctaactctgatggaggaggtgtagctctgccctctatggagtcctcagaattgggagagagacaagcagtaccaagggtaactctacatcacaaaacgtaaatggtacagatggcccatccttcattcaaccgttcaatatttactgagcacttactaaaagcatttatatatgtgtgtgtgtgtgtgcgtcatatgtatatgccaggtattgtgctccttgctaggtatgtgaggcacatcaaaggcccaaaaggtcagagtcccttcagattccccagagcttctgaaacacttatttacagctggggttaagggatacaatagagtttgggggtacctggcacactatttggtgaatgaataaatattacagaatctgaaacggcagtgcctttggaaggcatctaatctgtgctaccatcaacccagttcctctaacttttcacaaacctagagtgttaaggaagtcccccaccatatacacctaccaacaccttccagttggtggttgagggatgacacagggaagttcaatcaaactaacttgtattctgacacatggcaagagctacatggcagcctttcagagagaggaaaacaggaacatagtttcccagatcttcctggagctaaatgctccccagttcccaaagcattgatatttgtggtccagcttccagacctgctttggcctactctgaacaaggaactttacagattcttaggcagtgtagtgcattggtggaatctgagaggagcagcaacctgtggcagcctggatataccactccatccttgrtaagagcagctccagccagcatcaagttttaggcaactctgtcccaccagtgattccctctgagcttggcctccaccccatgcttggtggcattccccaagctgctaccttatcacatggggcactagttcatgtggggttattttgaccttaattttgattcatctgtgtcattctgtttcagggttctmaggaggtrtggggagggaagcaggattaggaattcatgagctggggtacgccgttccagtaccctcctgcaaccccaggccccaattgtgggtcctgctcactctaggattaaggcagagagccatctggtggatgttgcctgacctgcatctgaggaggaggagaggtgggggtggaagggcaaagggtgtccttccagtagagagcagaagagagtgaagaaagctggctagcttccgcaaatactaaatacttccttccccaggggtgaactagggaaccaaaggcttagcagcaatgggaactggacctcattttgaaaaagtgggagtgaggctttggggtgttccatacaccggggttctaacataatcctattccctattctctctcctcctcagccaaactttctgaggatgttgtttatgctaactgcttatatccattcactctttttttggtagagacggggtttcatgatgttgcccaggctggtctcaaacgcctaggctcaagcaatcctcctgtcttggcctcccaaagtgctgggattacaggcatgaaaccagcctccattcactcttgaactcactcacttcmatctggcttctgcctccaggcccttgccattccactgaagcagcccttaccaaggttaccagggacttctaagttgccaaaattacttttcagtccttacctccctggaacttactactataaactatttactccctgaacatctttaaactgtcctctcctgattttccctgatcatttaacttctctaatggattcttcttcctccctgaccttcctccctaccctcactctccctgaggaatctcatctctttccctaacttgtatgccttctatgctaatgattctcaagtctgtgtctcctgagcttccgaccttcatctccaactgcctacttgacttctccacctttttgtacaggaacctcaaatacaccaaagctaagcctgaactcatcacattcccaatgctatttcttcttctgtaattccttaccagttaatacaactggcaaccaccctttaatattcttctacctttacatccagtcaaccaaattatgttgattgtagggccctctcatgtcttgcttggatgactcaaacagccaaattggtcatttggtccaactcactccctaaaatccatattccacactgacacttaagagtgatctttctgaaataaaagatttgaatcatttgctttaaacactccagtgccttcccattacacacagggtaaagcccaagatccttagcctgacatttgagacttttgactggattcctgcctccttttcctctctgtcccccttgtgcagtgcgtgcaagcacttgtgcaggcacacaaacccgccccagactccctggctgttctgtacctctatacctttcttcatgctgttccctgcctgtttacccttctttgcctgataaacatcccctaatccatggagattcagctcaggcttcaccttccctgggaaacttccctgagctcccatactgggtcaatagcctctcttctgtgctgctacaactattatatagcacttatcacaccatrttgccagcttgctcccatcttgcccatataagctcctccaaggcacaaatgtctgctctctgccctattattcatacaaagtctggaacagactgtctctcattttgtttatcactgtatatccagtacctggcatactgtaggtactcaacattcatggaaagagagacaggatatcaaagtgtattccaytgaagtgaattctataggctttaccagtagttaattcaggattttgtgctatcatctactcagctcaagcccaacaattctggttcttagttttcctcaaccccacactggtttggtataaaaaagacccagtggtacagtggacatgagaagtccatgtgacctggaaagccaagagcttgagatagaagtctctggcccttagtctaaacttactgattgctggaagctgtgggacagggttgcactagactcaggcacagggctatggcccttccagaccctccagctacagcctggatggctaatctttccagctctgtcccttcccaccccctaaagccaaaaaagcaaagatratacccaagtctcactttgtccccacagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtgagttcctaacagtaggaatccagtcaggggagcctgaagccactttgttcagcccccaacctctccactcctacatgttatcaaggaagtaatgaggcagcatggtacagtccaaagcacaaggctagggggccagacagatagatgtaggttcaaatcctgggtttgcctcttactgactgtgactttgagcaagctacctaacctctcaaaactgcagcctccctgtcggaaaaatggggataatatgccagtatcataaaggttttgtgaggattgaatgaaaatacatgaaaaccaccgggcacagcggctcacgcctgtaatcccagcactttgggaggccgaggtgggtggatcacaaggtcaagagagatcaagaccatcctggccaacatggtgaaaccccgcctctactaaaaatacaaaaaattagctgggcgtggtggygggcgcctgtagtcccagctactcgggaggctgaggcaggagaatcacttgaacccaggaggcagaggttgcagtgagccgagattgcgccactgtactccagcctggcaacagagtgagactccgtctcaaaaaaaaaaaaaaagaaaagaaaatacatgaaaaccaacaaacaactggtacatcagaggctgaagtaaaattstaactgtcactgcgcacccactgtgacctgtgctgggttctcctgtggaagaggtagtcaataaagtacagcacttactttctgtgaactcagattcaagttttaagaaataaagtttggccttttctagtccaagatccctaagaggggaaaggagctggagcatgacttggacactattcccctggtgtggtgatctcaatttaaccagtattttaaaagcttcttatgtgcctagcatgatgctctgtcttcctgttgcttgctgtgatagaatcgtagatcaccaaagctggaaaggtcttcagtgaaggggcaactaaggctgagagaggcaagtcagtggcagtgctggtacccaggcccacactcctgaccctcagatcacagctccttttcagtgtgatgccctgtatgtcttaaaacataaataaaagtaggttacagtcatacagtatggctgtggagggttggagtggagggcaggttgttccccacattcttccttctctgcccacgagtcagccctgagcagagattcagggtcctgtcctgtctagcctggcttttggtttccctccccaacaggtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggtaagtgccctgcccctggaggtagcgtctagctgggctcccctaaaggaaaggaggaggagaaacaagaaatctacgaccattcttctgccatgcttggacctgggaagggagtaacagacctctaagcattccttgctctcagtcaggataaacctaatctttcccaaactatgctcaagtccctccattccttgcagtcagggaagacaacagcaactagtggagggggaaggggattctggtgggggtgctggcccccagcctaagtcttccccacaggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaacatttgcttgctgactccatattaggtattcccagaagagcctggtctgctttctctctccaccccccaacccgccatgtctcccttcacccccaggggctgttggtaattccattgagtctgaggcagggcccccaagaatcaaagctgcctcagattcaggtctgttcagctttgacagtgttcccatcatcactggacaagggacaagaacagtctcatccagtctgaggttagcccaagccaggtctcagctaagagctgacaccctaaacccttgtctcttgggttcatcttcaatatccctggaagatgtccccttccccccatcttactctcatagacctaagtaatcaaaagtagaatgggtagaacagaggggccagaaccagcacatggatgaatatacttcctttatcgagggtgacaaaccaaaacaaaaaaagaccaaacatgtaaaaacccagggttctagaaatacaaactcaattcattcaaattcaagctcatccagaccctggtcacaaaccctagtgaggtgcatgtgagcaccaagtcagggagagggggcaggagtgactctgaggccaacagagagggtgggaaggggatctccctaggtcccctggtgatcaccccccacccaaactggtatctccacattctcaatgactatgaagacataccaggctctgtccttttggcccccaccccatccctggccagagcttcaaaggccagtcccaaaaggttctaccctcacttgctcaggcttctagccttcctcttctcctccttcttcacatttttctctgtgattagtagcaggttagggtactgtataagccgcagtgaggctgggggccaagggggtggggtagagatgggatgaagagaggagaagagctgtccaaggacccctctcttcatgggatcccaaactgtacaaccagctcctcttttgcgtccacacggatctgagaaagtgcactgtaggcataagcagctatcctggagacctgagacagagaggggccggggaggagaggaacagagacaggtgaggagggcaatcaggaaaaatggggaggggagattagatggtgatggagaaggagggaatgaaggggaacaggaaggcaaagagaaagacagggatgggagagacagaaggaaaagaacaaaggggagtgaaacaataaaggttgcaggaaggagataggaaagacataaaaagttaagagaacgaggtgggagggagctggggcctacaaggctaccaggctccctaactccaccttccctacctcctctgaggcagagtgggtgaaccctctgccataccctgggcagtgtgagaagggtgggcaggggcaggtgaggggtgtctcacctgctgcaaatcagagaacgggatgggctcactggccagcacttggtggggctggctggtaagagacggcagcggtggcagcttcttccaatgggtcaggctgctgctcagcacagccaagcgggtgctgaccaagagagagggggtgggggtaggcagttaagcyacagtctgccctgcccagcccaggtaagcctcatcccctcaggccagagaagcagggtgtcgaggaggggtatctgggagggaaggtctcagctcatcacagactcaatctaggcccatctcccttggcctcagygccctcaagagtgtcacagggtaaacagggctgacatgaataactactgaagcacccaagtgatctgtggtcagtctccagggctgcaccaaatgagaagcttggactaggggccaggctccaaagctggaacagtgatggagggtgggagcccaagtagcctgagggacccacgctggccaggtgctcacctgtactgcctggcacggtccatgtactcatgctgctccatgccctgtgagtctgcagcagacacatcaatgatgttgctatggggagaggagacagagatgacatgacaggtgcttccgagaaggacaaacaggactcagtgccaggtaccaactccagggctatctgacaccagtttccctcctgcctactggagcagggctggacatggaggcacctctccccagtgaccttgtcccatcccccatgtcctgagcctggctccttctatcctagcctttaatatggatagaggagctctgacccaggcctggtcctctgacacttacctggctgtcttggcaaggatggaagagagcagggcctgctcatcagtgcgagcggaaggcaggctgtggtagttgggctcggctccattgagagctttggtaggggggctgctagggtccagcagcagcttccgctcctctcggtcctagaagtggtcatgggagagaagtcagccccaggacccgtagatcctgcctttcacgggtgctacccttagcccagctctgaccttaaacaccaaaaatgtttctataaggaatatctaaagtgcccagctttatggaatgccagataagactcagttcctgcctatccttgggagctcaactgagttggtgttctaggataaatgagagtggaaccaggcagtcctagaggccctgaaaaaatggacagaggcacaaagcaggtagtcagcaacagccctggagcttgaaaaacattctaggacctggcaaagaaaggatactagaggctggaagacagwggagctgagacatagcaagcactgggatctaaaggggaaatcagtgcaagtcaagagcccaagaacagccttcctcatcccctaggaccaggccttccccagcaaagctgttcgcttccaagatggaagccctggcgagtccagacaaagccctaggccccaagagaaagcaagcccaacctctccatggccatttctcaaattatgtcagggcaggaatcccagcccagctctgggtcacacagtacaagtgtgttcccttcttgaaggcaggtcccttcgaaggtgttcaccctcctgtgctctggtgctctttttgtacgtgactcccagaaccaaactgagtgtacatggtgtatcctgatctgagcagtacagctgtagccatgtatggtgattcacaccagtaatcccaacactttgggagcccaaggcagaaggattgcttgagtccaggagtttgagaccagcctgggcaacaaagcaagacctcgtctttgcaaaaaaaaaaaattagctggacttggtagtgtgagccctgcagtcccacctacttgggaggctgaagtgcaacgactgtatgaacccagggtttgaggctgcagtgagctaggactgtgccactgtactccagtctgggcaagagagcaagaccccatctcaaaacaaacaacaatggcgctgttccctcccttgctaaaccacctgagtagcccatgtaaattttcagcagccctgttcctgctggcctgtgctgataatcacaacccctgaactaatgtaagaccaaaccaagcttcctcattggtttggtcttcctccttgtcctctttcagtcccctgttctatctactgtaatatttctggatttgaccctgccttgagaccatcagctgcaaatccttgcttgctgtatcagcagtaaatgagaaaaacagacctgctgggtatctatccaacccataaagagcaagagtgccctgaacaaagccaaggatrggcccagggggacatcctggctaatgctgactcaccaaccttcagtgccagactcctcaatgctcccctccaggcctatctcagttcctcagtctttcctgctgcaggccgcagctcccctgcccacaactccacaactctccttgtagagggctacttcctcctgccctgcttagggaggcccagccttttcaccttactcttctttctcaaggctaggttgcccaagtgtcctcaggcaatttgatccagttcccaacagcaagagacagaagctgtgggctttgccccatcacctctataaactcccagacacccttcctccctaaatacataggctcagtattaaagagctaaaaagacaaaatgtttgccaaagataaaactatgtatttctaaggaaagctggctccataatgaggcccaagttagcttcctatgtgtctgtcctcccagctccacttcagacagatcttcctgcaggacagggtagtctcttccctatcaggggttcttcaagaagaaggttggctgatcacttctcagccttcagctaagatcaagtgaacaacaaggttattttcttgaaacccagacttaaagaagaggccatgctacctacttcagagcagacaaacatcaccccactcccaaagtgcgagtggagcatgggttaggtttgtcacatcaaggtttgtctctgcattagtgtaacccaagaggcagggtttcactgtctaccttagcacagacatagcagcctgcccrtgactggccacctggtctaggggcatggctgagacagcttggccccatggataaagtacatggcctagcgtcagaacacctgggcactagcacttctcagcttggccaaatcacttagcttctctgaacttcttcctcacctttcaatagacataacccacactaatatgacggatgtctggcaagagtcaaattagataactgtgaaggccctttgtaaactgtaacgtgttgtatattttttattatgataaagagacagagatgagagtcggagaggggcctgcccaagaactcaaagagggactgtgggatggtggatggttatggcccttgctacatgaggcctcaaatcacccagcagtgattaagcaccttctctgggtgttaggaacagaaatgagagccccccaaggagaaggtagagattcaggagagcagcaggcccagctctcccttccaagtagaagcttgtatcctttctcatacggcattaatccttcttgactcattccctgcaagagtccatattatgctttaagggacaatttcccactaggctacagctctcccagtaggcagggttattgttgtctctttctcaaaaaggtggaagtgaagtgagaggtattaggcacaacacatgcctaacacagggcaaaggaaatatgtgttcattgggtgtatggagaattgagaaccagaagccacccttgcttcccatacaaacgacattttcctaggcttaagcccttaatccaaaatacgttcactgaagaacgaactacttcccaagtaccagtgatataatctatttttgtgaccatcttccccattagaccgtgagctacctgaaacctttctactctctcaggtctactatatgttcaaatgtagaatccgggcttagagacgatcaaaaaaggagagtagacagcaacttgagacttcatccttgaatgtcaggccaggcagggcagggattagagtgtggggagaagtgagaatgcactaagaggaagagggagaatttaaaactgtacaggtctccccagcctaaccctttctccaaaggtatcagatctacagccaaattctcagaataggcatgtctccagctaaaggaaccctcaggccccaggcagactgcactgaggcaagccaaactcagaaccaaatgaacttcccgctccatttctcttttcccacaatctagccaaagctaaatcctctttgttgcttcccagacaatttcccacatgtcccgatgtcctcactgtatcgattaaatccttcattggccaattcaaaggccaccaacttccagagtcgtcccctggccctagactagcagcgaccttccttctgcaaccccagggactaagacgatacacgaattcctgattcatctcaggacagactaactcagggcctcagcttacccacccctaaaatggattcgcaaagcccactaatacacagaagacacaggaagctggggaagggagtgtttcccggggacctagactgaggatccttgaatctgaaaagttttgaaggtaggagcaaacggaagtggtgggagcgagccggacaggcggctgcctgcacaccccgaggcggggactgtgtagaaatctggggctttaacaggggtaggagcccggcttggcgtctcctctgtaatctgtcccctccaggcctccgtattcagtgagccctgcagtccggctgcccgtcctccgcaggtttctttctgggccccatgccccagtgtcttagccctcattcccgagccccgcctgccgcggccgcacctggtccgagtcctcgttctcgctgctgtagcagcaccccatggccggggtcgggccgggcgctcaggccgcgccgaggagggacggcgtccgtgaggagcccttccggtcacatgacccgcggcggcctcccgcaggcaaccacccgcccccaccccccgtaccccctgtcccggagccgcttggccgcctcagtcaataccccggcttccggtcccgcccgctagcgcgtgatcgttgtcaaccaatgggaaggcgtaaccgtacacgcaagcacgtgatgcggggaaagggcggggcggatcacatgacttcatctttccagtctctaaactggcagtagtggccatcgtgaattgtgttatgcgttctcgtggccactaggccacttttctgggccattgagcgaactcgtaccaaatgccctcgtatgcccttgtgatatactcttctaaatgccatgcgaggggcgactgggatccaggcctgatgctccagatcgtacggtctgggtgcacacacacagatgatccagatgaccagtacctagtcggggaacacagagggtgtatcgcccagctgggctgggggtgaatacacagagggtgtattctccacctgggctggggatctgcgacttacaggaagaagggaccttatactaccttcacatgctgacgcgcagcggagataaatcctggtagaggagatagaagccacctcactgacctctctgctttcaggcttttatctttaattctgccttttttaacagcacccattgtaatcgaacgcacaaagctgaccatcagttctcttttcctaacccccgctccatgtcttcccttgggccctgaacacaggtccaagtccgtccaagattgtatagtgatccatttgttgttcatgagcgtgtgattgggtgttcaccagcatgtatcaaatgtgccaccctcaaatcttgttttggcacattacccgtctgacataacaagagcctgacacctctcccactgcatgttctggggtgaggggtggaggggtcagcaatgtgtttcactggacatagagaaataatgtagtttcctgattgatctactggactttgtacatgcagcctggtctgcctactgtctttactgtcttcgagactcagtacaatgtcctcctgattaccttctctgactccattctctggacatgcccagctccctatgcttaatcctcatccagtgttaattcatgcatttattgaatcaacaaatatttgctgagcgtctactatgtgccacacattgttatatctggatatgcagcagttcacaaaacagccaaagtccctgtagtcatggaacatccaatagtgatcacactatattgtattctctgttcctgggtcagtctcacctaccaaacttgggagttcctggagcacagtgacaggttctgactcttccctgtagcccaaggcatggccttgcttacagaaaacttgcatatcaatgagcatgttacagtcaccccatcaccttggctcaccccatgccccatcttctgatccaaagtattggagaagtcaccagatctcatacctcttataacccctcaaatcaagaccctgaggttctgtaaatcttttgaggttcctgaagggtaggaggcagctcaagctcgtccctggggctggtaacttgaactgcaggtctcaggtgacagcagcagcctcagcatgaataattgaaagccattccagcctcctacctcagggttatcccccgcagcaggccctggactccccgacctgtcctgtgctctggtcctccagcccaggtaagcagggccctggattgtgggttcccaagctcaccagttcaagcccaccgcatcactcacctattcacacccatccatacactctttcatttttactccccgccatcaccaggggccttgcaagaaggccggcaaggaggtcagatctggatgaggaggagaatggtccaggacatgggaggagaggcccattccccataggtccctggagagaagagctgagtagagggaaaatgtgtgctgtgtgttatgtgtatgtacacatttgtgaagggaattctgagacagcacaggagaagaggggaatacagcggagaggagatggggctggagaattattaaagaatcaaagactcctcccatcctcagggaagagcaggcagagggagagtcctggggtgggaaagaggacatctcactctaacaccctatggggtattttgattgcattttactgaggcagggcacagtgatagtgaaggtgtttttgactgcaaatctatgctcttttgctacacagcagtggtcagaggagaccaggcaggcagagggtaggggtgggggaagatatcccagaggtgaattagtgaaaggggtcctgaagaaggggtgacttcaaggataaagagaaacaagtcaggggaacaatgtgaagatgggaccaggggttgggaccgggaagaggtggtttggggctgggtgctgaaagtagacagtatagagtccttgaaagtacacaggcttggaatcacactaacctggattcaaatcccagttctgctctgtgactctggacaaaagacttagcctttctgagccgtggtttgtgaaatataaggataataattgctactggcaaaagctacacaaataggcaaattgtgggtatgggattccctccctacctccctccaccccagggcccaggtagggaccatgtcccctgccattgcattggccttcctgccactggtggtaacattgctggtgcggtaccggcactacttccgattgctggtgcgcacggtcttgctgcgaagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagtgttccctagccttctgctccaagaagtacccccaagacagtgaaggaatatttgggatctgttgctgcttaactggatgaattgggcaggttcttgatcctcttttagggcctcttttttttctcatctggaaatgaggagcttggactaagtcatttattcagcaaacatttattgccacctcttttgtattaggaatgtgctaggtgccagggagaggggtagaggccacagagatgaatgagccacaaatgctggcctcaaaggaaccataatacacagtggaataaccatctcagcagataacccatagctttgtaattatctgtctccacatctttcctctccaccatggaggcttccacataccatttagggtagctgtctgcctggatttatctcaatcccagcataagtgcttttagggtcttatttaagaaattcggctgtgtggtggctggtgcctgtaatcccagcactttgagaggccgaggtgggcagattgcttgagctcaggagtttgagaccggcttgggcaacatggcaaaaacccatctctacaaaaaatacaaaaattacccaggcatggtggcacatgcctgtggtcccagctacttgggaggctgaggtgggaggattgcttgagcccaggaggctgaggctgcagtgagctgtgattgtgccactgcactccagcatgggtgacagagcaagaacctgtctcaaaaaaaaaaaaaaaaagaaaaagaaaagaaaagaaattcactggctgggcatggtggctcatgcctgtaatcccagcactttgggaggccaaagcaggaggatcacttgagcccaggagttcgagactagcctgggtaacaaagcaagacccccgtttctacaaaaaatttaaaaattagccgggtgtggtggtgagtaactgtggttccagctactggaaatgctgaggtgggaggattgcctgagcctgggtggtcaaggctgcagtgagccgtgatcatgctactgcactccagcctgggcaacacagcaagacttggtctcaaaaataaataaataaaagttcatccaattccaagatcagaaatacatttgatgagcaataaaaggggaatgaaactacaaattctaacagagacctttcataaatctgaaagatagggtggttgtttctgcctgggacttcatggagaaagagcaacatttgaactgaatctggaagttctgagttggccaggcagatggcgatgggggtgggaagggcaaagccagccacatatacacatgtggcatgaaggaatgagacagcttgatggattctgggcacagttgtttgggatggctgtgatacaggccacaggtgggaagtactgagagatgaacctggaaaggtaggataggatcaggtccaaggtcctgaatgccaggctgagaatcccaagttcaatcccaaaggccttcagctcacaggagccaaggagtaataaggtcagatttgttggaaagattccagggctggtgtgaagactacactgtaggagacggggaccaggagggcagctggggctatggtacaagagacagatgagaccccggctggttgggagctgcagtgaggcaggtaggcatttgagatatcttttatcaggggccctgcatccatctcccatgtcttctgcaacagccatctcccctcataggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtcagcctcccatctccccaacccagatttttgtcaccccaggccttgcccccagacatcccttgtgaaggactcccatctaaggagaaggaagcacctccactctggggactgtgatgctggatggtgtgtgagctcctgccctcctgtcccaagtcatctgcacattattttctgccggatgacgaaagaaacagctaagaggaaggtctctggaacccagcaaatttgggtccagctcttactctgcctcttgttagctacgtgaccttgagcaaagcatgcatcctctgaaccttagcttcttcagaatggaaatcacaatactgatcctgacttcttaggttctgaggtcagaggaaatgtgagaacactcatgggaagctaagccaggacctggcatgaagtaagccagatcctggtggggtcttgactgggagaacaattccccccaccctcacctccagctccccctatccccacaggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaaatacttaaactctctgagccttcttttttttgtataattatggtgaggatgaagtgagagacttatcagcctagaaagcatcatctgctagatcctcaattaatagtcaaaattatttcctgtgctttagggaaaagagcttgggctgagtgtcagcagcctgggctctaatctggcccagaagtcacatggtacccctgtaaaatagggtaccacaagatgagaaccttggctccctggctcccagcccgattattcccagctcagggcaaaaagctcttcctgggtagatttctggagtaaggctgggtcatggcccactgaaggaggtctctgtctgtgctgaggtctctgtgctgtgctagctgctcactcacccaggcctgatgctgctgttcctgctgctgcagctctgtctcttccacacagggtcgatccagattaaaccacagagtctcagtcacacgagggaagagtgaggggaacaaagtggacatggctcctagactgagggaaagggtcaagtgaatgtgttttgctttgtttttgtttttaatttggttgtaatttgatttrgggatagggtggaagacagcaggaaagcagcccctccccctaggaatcagacagacctggctttgagtcctggctccaccacttactagctgtttgaccttggctgagtcacttaacctctctgagcctcagtgtcttcatctgtaaaatggggataataacaattataccactgtcaaagttattctgataattaagtaaataatggatcaacaaagctgtttgcaggctgttcaaggagggatgagaatgggagtcaagtgtagggataggaatccagaatgcagactggcattatgaaattatacaaaattagaggtagcagggttctactgaaactatccctacctcctccacacactaaaacctgctttttgaccctttatgatggcccataccacacccacccagtgtcagaaatttaggacactaacgacctctcatgaatcacagccaaatgtcggggtggagggattgtagcatatgcaagcagggttcagtaagacattctaggaggcatgaataagtggataaataagtagatggaagattgaatggatgaactaacattataagggtacaatcagctttgagcggctgagggagccgaccaggagtgccagataatctgaattaaacttaggacaggcgaactgaggcccagcgacaggcagagactggctttaggtcatacagtgtgtcggggcttagaattcctccgtgaaagggatragcaggagaaaataatcgatgcctggtcctgcttttgtcttaatttatctgaccgacccagggccagccgctgcccttccctgtatctcagattcccaacccgcgtaattaggcacgacggtaaacaccctcatgtccaagaagtactgacagaccagcgatctcggctccgaaagcccaacccaccgtcgcaaagccaccgccctttctttgctcattacgataatgaccatgcagttgaccaacagaaagaaagcagggcgggtctcagacagaaatttggccttatagggttgctaaacgcgaaaaaagcggggcctgggtaggaccaattaactgaaagaaatgctgggtgacaggaagtgacaccaatgaatgacggaccttgtgtgacggggtggggcttagtctcgaggaagcggccaatgagctggagctctttaagggttaaggactctcaatatggagctcctggggagtcgggtcaaaggaaatgggtttctctgggggaaaaaggaatgaaggggcaaggagacggttgcagccttgcgtctgtacttaccgcgccgggaggctgctgccggcggcgacccggaagcgcttcacccagcctgagcggaagaacccaccagaatccgggactcaccaaacgcatgcgtccttcgtctccttttgttttccccgctcccgcccactaaaccggatgtgacgttgacctaccttagtcacattgttagggaaggaagtgtgccgcgcctacctatctgccccsccttgagtctcagccagtcggcgtctccatcctggcgccagcactacggtctcgtttaaccactgccccgtttaacccctgcccttttgttgccagtcaccatttgcttgttaaccccttctgaagaagagctgacagcaaccttttagtgcgagggccattcgtcctgctgcatcccagaaaactaatctgttactacttcagaattgctggttgatgttaggcccctcctatctgtgctctctcagctacagtttcccgtttgagcatattcattcttttttatttttgctctgaacaaaaatattagagttacaatattactatattccaggccttgctagaaactggggataaatctaggaatatggtcgcttccctggaagacctcacagtccagggaagccaaaccctgcagacatgcagtagacttagtggtctctcttaaggttgcttgttgagttttgacattggagattatgtacagacttgaatgactagttagcctcaggcacagcattctgttgctgggggaatcagctgccctcctcaggcctgggccaagtacacttagagatcgccctcgtcacctctcccatcctttgctgatgcctctgttctagtaacctctgactcagcttcgcctttagagatactcatgctttctggcaacagaggtccttcaaacccaattcctattaaactccatcacttaccagcctctttcagggacagcagttatccgcatttccagtactgtcctggccagatgtgtgagttttggcaattccttttcctctctctggactcagcttctttgtcaaccagcatcataatctctgcccagccttccttctatcctgggctgatgtgaagattggataagaattgttcaagaggtcgtgtactgtgcatattgaatgtgattatattgccaaatagcactgtttgttatagtttttcattaaagagtaaactttgcctcttggaaatgactacctttttcattcattcaacaaatacctactgagtgccttagtatatgtccatcactattcttagtagtgggtatacaatagtaaacaaaacagaccaaaaaagtccctcttttcatgcagccttcattctgagagaggtaaacaataaagaagatagataaataaaatatgtagttgtaagattgcagtaaataagagaaaaaataaatctgagaagtgggaataaaatatttgcaggggaggtgttttatttcagactggggggccaaagtcactgggaaggtgacttttgagtaaaggtctgaaggagcagagagccttctgatatttgtggaagagcatttcagagagagagaatacaagtgcagagggcctagaatggcttgggcatagtgtcctctagggagagtaataggtaggagatgaggagttggggagccagtggagggttgtgagcacagggtccacacaatctgatttacagtttaactgagttactctggctgttctccaaatagactggggtaggggagacaatggcagaagcagggagaccatttgggagcctattatgataatctagaggtagtggatgagaagtggttgaattctgaatttatttagatggtagagactacaaggtttgctaacagatggacaatgccagaataagaaaggagccacgatttttgggctgaacgactagaagattggtgttgccacttttttgagttgggaaggaatggggaggtgatgaggggtttggtttttttttgacagggagcttaggtttgagtgtgttgagtctgagatgcccattagagtagagatgttggggcggcaggaaggcatatgagtctgcaggtcagggcagagatctgggctggatagatcatttgggagtcattggcatgtagatggtgtttaaagtcatgagactggatgagatcaccaagggagtgaatgtagttggaaaatagtttcctccaatattcagaatttgaggaaactaggaaaagcagcaaaccagatggagaaggaaggccaaaaagataagtagaaagctgggtgagttgatggtatcttggaagccatgtaaagaaagggtggtaggagaaaatggtttactgcagcctcattctgtacaaaattgtgcttttgtttatttccccaacagaccatgagctccttgagggcagggactgaatggttactatgtccccagggcccagcatgaccttctcctggattcctcatcttccttctgtgacctgtgtctccatcagtttctcctccggcatctttttcttacaggattcttacctcaggtaccatttgccccgtccttcctgataattccgcctgctggaaattccctagtaacagagtttcttttcagggtcatcagccaggctcagtaagtaatgatgactggttagctggtgacatttattgagtaccaactgagtgccagacacctttctaggccctggggacagaggggaagcagaaataattcctgccctagagaaaaatagagtatagtgagtactaagacaattatagacaattatagaggagggtaataaatgttaaaatcaatgtatgtagagaatacatgagaacacagaggagggattgatgaatgggttctgaacaaactaagtttagacttttgttccagaaaaggaaacatttgagtgggccttgagggatgagtaggagttaagcccactggtaaataagtaggaaaagagggtgcacaaagaggcatatttcattcaagggcatgtttggagaacattgagaatctgggcagaactagatatgtggagtggagaaagatgagaaagaatgataggggacccagatagggaaggtctttggtggccctatatggagtggatgggatgggatctgggcatcttgggtctcacctttgtcttattgccgacttgctggggaccccaggtagatgtctccccattcacaagcttccgtgttctctaacataatatctaaccatgtcgccagctctgatgtgagtccctggaagggattcccctagcttgatcctttccattcttagatttttacatttgccttatttgtgatttatacaaaccagggcctaggaatggaaagcagggtcaggatggagatttctcaacagaaatcaataaatccagagcccagaggctgaagatggaaaccatgattctatgcagagaattctctaggatccaggaagggccagagttgagtggtgtgaattcagtgctagtgaaagctgcttactcattccttccataaaccttgaggagcatggctgaccctggtaggggacaggggagaatgtaacagtcacagtcactacctttcatacatatggagggatagttggtctccagagagttttcccactcatagtctccacttatccttagcccagccctggggattctgccttcatttagcagatgaggaacctgaggctcaggaaagtaaagcggcttgtctgagttgaagctacaactcaagaatgtcaaaatcttgcattgttccacaaatcttccttatgggctgatatgtgcttgccgatggggactcacagaggaattcgatttgagtcctagtcctctgcaactacccagtatggtgtggataccagactaacgcaagtcattaggcccttgaggccagatctctgtgtgattcatctgtatttccccggcaccttgcacagtgtctagcacagagtagccactcaacaaatgtttatataagatgggtttttttccttgggtctaatggaattatagttcacgtgatgaatggtataacagggataggttctaaaaagagaaaagtgggaatgttaaaaagtgaagagcagtgtgggaggggaggtggagaaggctcctcagagaagatgagaccttgcaagaggagttaggaaagaatattctagtcaagagcagacagcatgtgcagaagtgcagaggcctgaaagggtgtggtgtgcccaggacatggcattgaccgagggcctgttgtgtggccatcgtggtgatgtgcactgtgaaagaaacaggaccaggagacagtaccctgtgctcaaaggacaaggcacagccttggaggaggacagggacatgctgagaaaggcttccttgagcaggggagacttctgctgggtcatgaaggatgcttcatagttcgagtcagagaggaggaaagaggaaacctcccaggtgtgaggggcctccttaggcaggggctgtggttggaaggaataaggagaatgcccaggcaggagagcatggtgtgtggagggcaggctggtcgggtgggaggggctgcagagctccactgggtgggctagctgagggagtgcaccttagcgtggagtataaggcttgttctgcctcatggtcactcaacacctcatttatttcccatcattgtggcctccctggacctgactctgagtttgggatggatagatgcgttggaagggatctctgtgaattatcttccagttccctagaaagccagccccaggagaggtgctccagccaggtccctatctgcatggtggttttgcgtatgtttgcttaccacaaatatatggtaaggtttcctcactaaggtttaatgggctaaggtttcctcactctgactacagcaaaatagatgcaaagtttgaagagaggccctctgcattggaggcaaaggctgaggagacacagacctacacacacacacaccccccctcactttcatgcagaggtggtaggcagaatgaaggctccctggagatacccatgtcctaatcctatggtgtgtatcctacctggcaaaagggactttgcagatgtgattaaggttaaggactttcacatggggtgattatccaggtgggcccaatctatttacatgaatccttaaaatcagataaaactttcccagctgtggtcagaaaacaagacgtgacaaggaagaagcatcagagagattctacattgctgactttgaagatggaggaaagggccatgagccaaggaacacaggtggcctctagaagctggaaaaggcaaggaaacggattctcccctagggcctccagaaagacctactgtcaccctaatttttttttaattttttaatttttttgagacagtcttgctctgtcccccaggctggagtgcaatagtgggatctcggctcactgcaacctctgcctcccaggttcaagcgattctcctgcctcagcctcccgagtagttgagattacaggcgcccaccaccacacccggctaatttttgtatttttagtagagacggggttttgccatgttggtcaggctggtctcgaacccctgacctcaggtgatccgcctgcctcagcctcccaaagtgctggtgtgagccaccgcacccggcccctgacaccctaaattgagacgcatgttacacttgtaacctgcagaactgtaagttaataagcttgtgttgtttgctgggcacagtggcacattcctgtagtcccagctactcgggaggctgtgataggtgtgttactggatagtgctctgtaatttcaggctcttggtgtcctgaacaaagaactggaccagacacacacagatattaagcacagtattacactcttagagggggagagtggactgacctctggcagatgagatcaacattagttttgtgtactctgggtctttgtgtgtgtgtgtgtgtgtgtgtgtgtgtgtgtgtgtgtgtgtgtgtgtgtgttctcttcccaaggctgcctaatctctagccagtgtctgcctttttgattgatagatgtgttgcttagttactttggcccttgtgtgtcacctccatcccataattttaagtacatgagtgatttgcagtccatatgcatgagcttcaatgagctaattaccaaacggggtcattttaaggatactttttctctttaatgtgcatgcccatctctgaggagctgcccgcaacaggtttggtccggatttagcccagatgggggcttctttttcacttttgttttggctgttctggtttttatctcgcttcttgctcacctgccccttcacctggcttctgctccctgcttttactcattctgcccttgatccaaattttaattccctttgctattctcctgctgtattttccctcttcccctgcttcaggaggatcgcttgaaccctgaagtttgggaccagcctgggcaacagagcgagaccttgtctcaaaaatcaattaattaattaatttgtgttgttttaagccacttagcttgtggtagtttgttatggcaccaacagaaaacaaatgcacaggtacacacgtatatcctcccaccctgatagacaaccacagtcatacacgctcaggcagatacaggcagggagacccaggaacatcagctggccctaagtgggggctggggagaaatgaagcttcaggtgtgtgctgcggggtgggtggtaaggcctgctccttggctggtgtggagaaactttgaccacatttctcagtcttaactttgctctgcttcctctcagtccttacgtcatacttttagcaacctttacaacaacattttgtcctaaaccctgttgcaaatacatgtatgaacctcaaagactatatattaaatgaaataagccagtcgcgaaaggacaaatactgtaggattccacttttctgaggttcctggagaagtcaaattcagagacagaaaataggatggtggtttccaggggctggggagtagggagttattactgttttggtatttttttgtttttacagatatcctgtttctacttaaagagttattaccgttgtcaagctgggcatggtggctcacgcctgtaatcccagcactttgggaggccgaagtgggcagatcacgaggtcaggagatcgagaccacgctgaaaccccgtctgtactaaaaatacaaaaaattagccgggcgtggtggcgggtgcctgtagttccatctactcgggaggctgaggcaggagaatgtcttgaacccgggaggcggagcttgcagtgatccgagatcgcccactgcactccagcctgggcgacagagccagactccrtctcaaaaaaaaaaaaagagttattaccattgaccatgaacaacacaggtttgaattgcatgggtccactaatatgtggatttttttcaatcacagataaaaaatacagtattcagaggttgcgaaacccacatatatgaagggtgggacatcagtatgtgtggatttgggtatggggggctcctggaaccaatcccctacatctgttgagggaggattgtatttaatggatacagtttcagctggggaagacaaaaagtgttctggatgagcctggtcatggtggcttatgcctgtaatcccaccattttgggaggccgaggtgggaggattactcgagcacaggagctcaagaccagcttgggcaacatggcaaaactccatctctaccaaaaatacaaaaattagccaggtatagtggtgtgtgtctgtggtcccagctacttgggaggctgaggtgggaggattgtttgagcccaggaggtagaggttgcagtgagacaagatggtgccattgcactccagcctgggtgatagagcaagaccctgtctaaaaaaaaaaaaaaaaaaagagttctggatggattcacaacaatgtgaatgtacttaatgtgagtgtactgaactggacatgtaaaaattgttaaaatgataatttttattatatgtatgttgtcacaattaaaaaaaaaaacaacttgtagattaggcaccattttggagaatgggttcgggggagcctccagtcgaacttccccactgcagtgcagctggaaactcagtaactggttctctgacacctccccgccactcccaccccagtgccacatatccccatctccatgccccactccagtccagagccatctatcgcctgggctactgcaataactggctagcttcccgccacaccacttcaaaccatacgtggctgcctaaaacctttccctggcttcccattgcttttagcctgtgagttgaagtccttgccaggcaagatctgcccctgccttcctgtccaccctcatctagagccaacctcgtccttgctttctgcaccccaaccacaccccaacagttttgcagatcttcagacccactaaaacatgttctgcctcagggcctttgcacaatgctcccattgcctgggactctgtccttcttctttactgggtcagctccctccrttttggtctcaagagaggtcccccctgcagattagctctggtgcaaggagcactcttccatagcatcttctcttttcctcatggcatctcacctaatacatacactcacacacacatttatgtgtgtgtgtgtatatgtgtgtgtatatatataaaacatatattttatatataaaatatatgttttatatatataaaatatattttatatataaaaaatattttatatatataaaacatatttttatatatatatataaaatgtatggtaaaatatatgtaacaaaaaatttacaattttcacctttttttttggacactgagtttcactcttgttgcccaggctggagtgcaatggcgcgatcttggctcaccacaacctccacctcctgggttcaagtgattctcccacctcagcttcccaagtagctgggattactacaggcacgtgccaccatggcctggctaattttgtatttttagtagagacggggtttctccatgttggttgggctggtctcaaactcccgacctcaggtgatctgcccacctcagcctcccaaagtgctgggattacaggcatgagccactgcgcccggccaattttagccatttttaaatgtacagttcagtggcattaagtacattcacattgtgtgtaaccatcactacatccattccccagaactctcatctttcccagctgaaactctgtaattaaacagtagctccccacccagcctccccaagcccctggcacccaccattctacttagtctctatgaatttttactactccaggtaccttaaatggaatcatacagtatttttctttttgtaattggcttatttcacttagcataatgtcttcaaagttcatctatgaagctgttgttgcatgtgtcagaattttcttcctttttaaggctgggtaatagtcatttgtacatatcacatgttgcatatccattcatcttttgataaacatttggattgtttccacttttgggctattgcaaatagtactgctataaaaatgattgaacaaataccacctattttaactatacatctaattgtgtgcttattcgtttaaattgtgcctctcttcctcatctctgggcatcacaagtgttcaccagcatatcctcagcacccagcacagtacctgggcatcagtattcaacaagtatctgttgaatgaatgaatgagacaccaaaatatacctactggacatatacagtgtctgtagtgtgtaaggaagagcagaggacttgaatctggggcccagctcattgattcctcattgcgtgctctgaccttgaccaaggcccttcacctttgtaaaccaaagagtatctgagacaaatctcaaccaatttaggaagtttgttttgccaaggctaagcatgcacccatgacacagcctcagggcgtcctgacaacatgtgcccaaggtggttggggcacagcatggttttatatattttaaggagacatgagacatcaatcaatatatgtaagatgtacattggttcagtctggaaaagtggaacagcttgaagtgggggtgggggtcttcctggtcataggtagttaagagataaccatttgcattcttttgagtttctggttagcctttccaaaggaagcaatcagatatgatatgcttttatctcagtgagcagagagatgactttgagttctgtctattctttgtccacaaattatgaggaaggtgtgtagttttttttctttttaatcttagtagctatttttcttggaatagaatgtgaggcaggtttgccctaagcagttctcagcttgactattccgttagtaattgacttggtcttagtaattgacttttcccatagtaattgacttgcccttagtaattttggggccctaagatttattttcctttcacaccttcaaacctcagtttccccatgtgtaatgtaggggcactatcagccccacagagttcttgtcagggtcaaacgaaacaatacatgtgataaggttcggcttctgacccaaggaactgctcagtgacctaatctagaggccttgatctaagtactgagggagagaggaggctccaactgggggagctgactgactggattcgaatccagcccaaggtctgttacccatcctctggggaccttggctctgtattcatttcctgtagctgctataacaaattactacaaacttcttggcttaaaccacacagatttgttatctttcaattctgaaggtcagaagccataaatcaatgtgtcagcaggactacattccttgtggaagcttccaagaacaatcaatttccttgccttttccagcttccagaagccacctgcatgcctgggctggtggcctcccttccttgtgtccctctaacctcttgtttccacctttatgtgtcctactactctctctgagctcctgcctccctcgcatcaggattacatcaagtccattcagaaaatccaggatcatctccccatctcaagacccatttcttaatcacatttgcaaagtcccttttgccatataaagtagcattcagatgttccagagattaggacgtggacacaggtaccatctctctcccatgtgggcctcagtttgcattttaggaaaataagagcattggtcatgccctgtcctccctgtcacccttgctctgtggagttctacctgaggcaggaatattgggtggaggccagagggttgggtcctgcctgcctgactaccctagcacccaaattctcacaatcttgtcaccagcagttatagccccagggcctggctgtcccccaacccgtgttccagtgccccactgttcccttccatttcctgggtgcttctgattcaggactttttcctggacccttcactggactcacaagaggggtgccctgtttattcagtccaccacgctcaatctcttgcaggagggagcacatgagtgagtgagtgcaggatctggttggctgatccaggtgctggcagcagcaagctccatgcagggccctcggccagtctagatgtgagcgagcaagggcaggatccagccggctgctctgggcactggcaggagaaatctccatgtggggcctgcggcagtgcccaggtgggggtgcccatgacccctaagccccagagggagtattacagtgctctcctagttctgctgtccatggacggtggtgtgttagcagctcagttggccccttgcatcgtctcatggggtggttgccctctgccagcaagggcaaagagccagtgtgacagcctttctgggtacccacacttggtgggtcccgagcccttggccagtgtccaagaagaatgaggttgtgcagacaattgaagaatgatgaaggtggagaattttattaagcaatgaaaacagctctcagcagaaaggggagctggagaggaaacaggaagggccagtcatcttcccccgaagtcaggccatctcttctgtagtccagccatctcttcctcaaagtccggttgtctcctcgaagtccagccatcttcccatctactgactgagtctggggcctttatatgcacaggacggggagtgcatgctgattggtttgtgagtatgcaaaacaggttaaagtgaagacatcactcaaagatgggcatgacagtgtagaaaaccaattaggaaagggtaagtatatgtaaaataggtgaagggtggggatcaatcagaggaaagcacaacaaatgggaagacaagtcttcaatctggtctgaggatttagcttgtagcttggctttcaggctttaaactggctttggcttggaagtggggtttcaccagggaccagtccctatttgcctaggcatttggctgcctcctgtccctctcatttccccctctgaagaggtacaactacctgttgttagaatagggacaaagacaatcttaactacttcctgctgacaggggatgctgttttgagcaaacagcaatcagagctccctcagaggcctatctaagcgtcccaggttaaagggagccatcattcaaggctctgttcggaatttgatggcctctaagtgagaagaaacagtttgggttattagatgacatggatcaaaatggaacaacaaggaggtaaagacagctcaaaaatcccaagtctgctgacatgcccagataactagtggctatagttatgcctgctaagatttggatgcatggtgcttggctttggtttgctcccttgttttcattttcccaaaaaaacctccagattatgagcaccacatcctatttactcctatcagctgcaggataattgcccagaactagaatattgattcatatttttacattacccatcccctctatttcttctgagctacaaccagagatcactagttggttcacaggaataagcaggattaatctaaaatgtaggcaaaagcttaaaaacaactgaaactagaatttaatgacaagtgtatgataaattttgaaacataatttttctctctccagtcctcatttctgttaaaaataaaccatgataggactgagttgtttgcaaaataaactttagtcttatacttggcctggtcatttgcataaagtgcagcaagaataatcattttcacataggcttttaaaattggctttgatggaactctgtttcacaaggaatctcaggtaggaccttttaaagctgagctcagccatgggtttgtaccctcaaatacctatgagttgggtaaattcttcttttcttgaggtcccagataacacagggctcttgggcctgttagaaaatgacattctctactcaccacaggttaggaaccctgtccagggactgtgtagacaaggtatgaggccagttttcccaaggggattttattggctctgcaagtcaagcttgattccctaaaggaaagcataccattccagtcaaaaccttggtaaaataaccggtttctccagttatatcctgctgcaaaagaaaatagattcttattgcactgatgcaaataactatattgccataagttaagaatatttgcaaatagtttccaaattctagagaaaccaggcagagagaaatatgctccaaattttcttcacaggagtataccttactcaattgttaaaagctgtagatagctcaaaagaagtttccttgactctggaaaaaacaaaacaaggatcagcaatgttttaagcaaaaagttaaaaaggattacttcagttttctattagttcagtttattcagttaactcttgttctgcttgatattcaggagaatttcagctctttatgactcctgtatgtttttcctctgttccaatgtcacaatctccaaagtcatcagaaacctgcatttgagggcacctttcaaagtccaatagctgtccacaaatcatcttttgaaaagggtcaaaacaagacaacaattgtctgtgaatgacaaaatatccttgggtagtcacagtcaaaaacacaattgacaaagaaatttgttttttctctgtggtttacaataacttaacacaataaccttaattattactgatagcatatactcagacatttgagttttagaaggcccatacaattaggccgggcaccatggctcatgcctgtaatcccagcactttgggaggccgaggtgggtggatcatgaggtcaagagatctagaccatcctggccaacatagtgaaaccctgtctctactaaagtacaaaaattagctgggcatggtggcacatgcctgtagtcccagctactcgggaggctgagggaggagaatcgcttgaaccctggaggcagaggttgcagtgagccaagattgtgccactgcactctagcctggtaacagcgcaagactctttctcaaataaatcccatacaattttggaacatatattaatattattcactaaaatataccctgaagaaagtcatacattatttttattttggcaatcccatgtaactaaatgtgttaaataatcctgtttacctctcttttggatgctccaggggccttcagtagcatccaaaagttaggggttagaaaagacaaccttgaacctgaagtttgaatttgggaagtctatcaaacacattaaagatttaaaacacttattattttgaaatagaactccagatcaccataagttatttattttagccaaaatgatgactcaaaaattttaaaacaaggcaaaaacctttcattatcctttattattacatgaaaatcttcttcgagagaaagtcaaatttcacccttgcatgtaaatccattttcagtagtctcaattacatgttgtaatggtaactcttagcaatttttaattttaatgtaaaacctggtaagtttttttaattatgtactaggcacagataaagtctgactctttacaacatagttaatggtgtggttaatccatatgaccccagaccttaccaaattgtaaagctggcaagtcaaacagttctcaaaagccaaagaagcagtttataaccttacaacatttagcaaacctagtatctgacctgcatacattagaccacatattttcattttgataacatttgtattttaccaattatcttcaaaattgtttttctttctcaaagattaaagtcacatgaactaaaaggcaatacagcttttgtttttccttcaaaaaatatttgatctaagcacttattttctttaagcaaattagagctctttttttatataaacatcacacacaaataacacatatgtgattacacagacagaagattcagtagttgtaagatttttcatttgccaatctcctaattggattattggcctcagggtggagcatttcaagaagcagagctaggaaagcatgcagtttccagggcctaataaacaggcatagctggaagacaaaaacagattttgaaaggggtctatctgcttttaattcctggggttctataagaaaaacagagtttttttttttttttccaaaatgggatccgtggtgacttctctgtttttcccaaggtgtcttatgctctcagaagttatcttagggcctctcatgcatgcgttaagagtgacaagacaaattggggaaaaataattcagttgactgagaaaaaattgttttgcagagaaacaagatccatgaagaaaaaaacacaaaggccttttaaatatacctatagcttggatatccacttttaattaagctgagcactctttaagataacccttttaaatcccttagtacccaactttagccatgccaagccacgaatatttctggcttttgaactttaccatttctttcaacattttgcacagggagagagaggccagaggcccgactggcagaaaacttttacccttctgtccacatgttcacaattctttccccttctcactccatccttattccactctcagccttcctcatctcagtaaatagccaagcactcctctctaattgctcagaccaacacactctggagtcatcctaattcctccctttctctcatgtcctccatctcagcaaatcctatcaaaacatccttcaaaagacatgacattactcctcccttttcaccacgtccactgccaccacatagccctggttcaagtcatggttgccttaaggctgggccattcacatagacatctgtgtcaattgtttgctttcccttgtccctagagtcagatcagatgctgaactggaaaaagcaaataaagtttccatttcattcagagtaaaatcccccatctttgctgagtctgaaccacggggccctgaagatctggcctggaccccacacctgccgctcccagctcactgctggccacactggcctcctcctcgctgtttgttcctgaaatgcactgagtacatttttgcttcagggcctttggacctacgggtccctctgtctggagcactccttcctccatgttcacatgactcccttcttacctcattatggtatcagcccaagcatcacctcctagatctttcctgtagaagatagtagcccctgcttcatcactctctgtccccttagcctgcttcagttttcttcagagcacaatcatcatctttatttgttttctgtcgtctctctctaacaacctcccacccccaaactagaatgtcagctctatgacagtagggactttttcttggtcacttctgtagctctagaacccagaacagcctagcacatggtagatgcccaataactaattctgagcttagtttttgaatgaatccccacttctaccctcctggtcaaggcaccatcatcccaggcctggacttgtgaaacagctttctaactggtctaccttgcccaattccagcctacacgtaatcccatctgaacacaccaagactgccaattgaactgtgacattcccctgcttaaaactctttcactgtgaccagttgtagaaacaacattttgtttatccatttatccatccgtggacacttgggttgctttcaacttttagctatcgtgaattaatgctgctgtgaatatgactgcacagatagctgtttgcatccctgctttcaattcttttgggtgtgtgcgcacaagaggaattgctggatcatatggtaattctatgtttaattttttttcacagcatctggaccattttacattccccctccactagatatgttattatatacaaaggtggacggctatacaaggacattccctacagcattgactataacagtgaaatatgagaagccacttaaattcaatagaataatgaaatagaatcatatagatctatgtacacagataagggaccatctatagtacattctgttaagtaaagcaagcaaagtgagctgggcacagtggctcatgcctgtaattctagcactttgggaggctgaggtgggaggatcacttgagcccaagacgtcaaggctgctatgacctatgattatgccactgcactccagcctgggtgacagagagagaccctgtcaaaaagaaaaagaaaaaagaaaagaaatcaaaatgcaagggaattaggggttattcttcttcctgaggactggtgccatggcatccagagaaagaacattggtggggatactgatgaaaaagaataaagtttgtagattagttaaaagtattcccttaatgttaatttcctgattttttaagtaattgggctttggttttgtcagatgccaacatttggggaaactggatgaaagcatatgggaaacctctttactacttttgcaatttttctgttaagtctaaaattatctcaaaacactaagttaagaaaatcaaataaacttgatgtcttaaaacaataccaattaggctgggcgcagtggctcatgcctgtaatcctagcaatttgggaggctgaagtgggccgataacctgaggtcgggagttcgagaccagcctggccaacatggtgaatccccacctctactgaaactacagaaattagcctggcatagtggcatgtgcctataatcccagctacctgggaggatgaggcaggagaatcactggaaccggaaggcagaggctgcagtgagctgagatcacaccactgcactccagcctgggggacagagcaagactctgtctcaaaacaaaacaaaacaaaaacacaatacttatttacttatacttcaagattttgtgagtttaattatacttcaagattttgtgagattttgcccaagaatttgggcaagactcatgattggcccatcttggccgggcgtggtggctcacccctgtagtcccagtattttgggaggcctaggttggaggattgtttgagcccaagagttgaagaccagcctgggcaacatggcgaaacctcctctctacaaaaatacaaaaattagctgggcgtggtggtgcgtgcctgtagtcccagatactcagggaggttgaggctgcagtgagccatgatggtgccactgcactccagctggggtgacagagtgagaccctgtctcctaaaaataaaaaataaggtaaaataaagattggcccatctaccctcaacagttgcctggactccctggggctcagtgcacctagatgctggactcggataaccatctgatctttgatgtagtggacagacactttgttcttgccatcatctttggtacctgagatagaaagccttaaagagaggccacgcccatgattaagtttcaggtcaaaacaacgagcaaaaaggcaacggctatagttgtaggtgtagcaaatcagtgtgccttttatctagaggctactgaaaaccagacattcattaaagatattctggtcacttggatgaaggctggccttggcattcacctgaatctttagtagagtctttagcaccattggcaactcagccagacctggccttggccacgatagtggagcctgggattggagggcatgaattttatgaagcctgtaatatcagaaattcgttggttgaggacatacctctttctttttggaccctgtgggcgtaatgctattgatacatgtgcagaggaggaattaatatgactgtgattgacagaataattatgaagtgcaaagacctcagatctgtgatcagcttccatagaagtatttgctcagaagcttctcagaaacattctcatgattgaagaagccttgaagagcccgtatttctgtctatgaaatctcctgtttattgtactatgaggacccatcagaaagtaactgaggtagtgctgatttcctgagcaattattcagtccactgtctcaaatccatcatgcagaatgttcacagagggtaaagtaagtttgactattataactactcacttttataagtgatttaatttaaagattaatatgataagtactctgtttttcctgggaattttgttgtagaaagagtaactgctgtgtggctaaactaaggttataagccaaattgtttcctcagagtttaagaaacacaatactaactctcatgggtttactagttgtctgttgctgcataacaaatcattccataattttgtggtgtattgctgcagacaatgttaaactaagtggatgaaaaggatattcacatagtctcagagtgtctccctacaaggtaggattactaacaaagggaaactaataattatatagtaaggaaatctccttaacccaataatcaccagcaataagatgcagcaaccctcatcatgtacctcttgatatgatgcactgacaaaagcacctctcttctctaattttcttgccaaaatgcataagctcaagctaattacaggaaaatatagacaaacccaaattgagggacattctgcaaaataactgaacagtaattctccaaaagtgtcaaggtcataaaagacaaagacattgaggaactgtcacagattggagggagactaaggggacatgacaactacatgcaacctggaatcatggactgaatcctgggccagagaaaggacattgggggggaaactggtgtaaagggcataaagcttgtagattagttaacagtattgcctcaatattaatttcctgatttttttaagaactgggctttggttacataagatgccaatatttggggaagttgcataaaaacatacgggaaatcttttgacgatgttttgcagtttttctgcaaatctaaaattatttcaaaacaaaaagtttaaaaatcaaatacacatagttgcttgaaatagtaactattttattatattccaagatgttgtgagtcaggaatttggccaaaactcaggtgggcgattcttctgcaaagacccccacaacacattcaaagtcacaggcagaggttgttgggggagggcattgaaaagaagagaagagtcataggtgggtgcaatggagggagggcagagggctgctgactatggtgcaggactcatccataatggagccctggggaggcaagggcttcataactagacactggtcttgtcacctcagactcacctgtagcaggaccagatactgaggtcagactgaaaacacaggctctgcctcaggagaggctctctactagctgagtaaatgatgacagtattggaaatgttcccaacatcataatgggaaaacatcacttcacactacataagcaatacacaggggcagtgccggtcgtcttcccaggttagtagcagttctactgcctccaagagtgttggagaaatacaaaccaagcattaggcacttttaacttgaaaacatgaagttctctttcctaactttctttgtttccttatttcttcttcttcttcttctccttcttcttcttcttcttcttcttcttcttcttcttcttcttcttcttcctcttcttcttcttcttcttctttcttcttcttctccttctccttttccttcttctttttttgctgagacagggtctcactctgacagtacagtggtgccatcacagctcactgcagcctcgacctccagggctcaagcaatcctcccagctcaccctcccaaatggctgaaactacaagctcgcaccaccatacgtggctaatttttctatttttgtgtgcagatgaagttttcctatgttgcccaagtggtctcaaactcctgggatcaagtgatccatccacctcaacctcccaaaacgctgggattacaggtgtaagccaccacacccagcccactaacttttttatatcggctaatgaaatagttttaagtttagaccctacgaggcataaagaaataattttagttatgttatcagatgtacagtaatactcaagtgtgcaactgtggataacttgagttcatgaggtttttgtttttttgtcaaaagaataaatttatagtgaaactacccaaaaaagcaaagtacagaacagtatgctaccatttgtgcacagaaatgggatatatatggtgtaactgcatcgaatttactggatgtatgtccagggaccagaactcttggtggcttcatgttcatacttttgcaagcacatgtgtagtatccttaacttaaaggtactgttgtatacattctagtgttatcaaaatttacatacatattatcaagtcagagaggtcattctgtgtcttagtattttcacttcatatttggtatatttatgtatgtatacacacatacctatatgtatttaaataagatttatagtcacatggtccaaaaatcaaaacaatgtggaaaggtttacagagaaaagtctcaagcctaatcctgttctctactgccaggtgaccatgttattaatttcttttcataccttgccacagaattttcacctgcaaacacagatattcttttcttttttaatgacagagtcacgttctgttatccaggctggagtgcagtggcgtgatcttggctcactgcaaactcctcccgggttcaagtgattctcctgtctcagcctcctgagtagctgggattacaggcatgtgccaccacacccagctaatttttgtatttttagtacagatggggttttatcatattgaccaggctgatgtcgaactcctgacctcaagtgatccgcctgcctcggcctcccacagtgctgggattacaggcgtgagccaccacgcccagtcaacacagacattcttactccttttttacagagaatttattattattattttttacatagcatttttctgcacctttctttttccacttaacaatgcacttgaagatttttccatatttgtacatcaggagctttctctttctttgttaccacattaaattccactgggtagatgtaccataatttaactgggtccttattgaaagacaattgagctgtctcctagacaaagccttgtgcaccttccckaacagagggtctaaccaagcaggcaggatggggttataaagtaggtggggaggtgggagagactccaccttcccaggtgggctgagaatggaggtaaggccctgcaacaggacagagggaaaagtggggatgagaggtgggaggcgagatagcgcccactgttctcgctcagccccctcctccgtttgccgctgacctgttggcctcccccaacctctgagcctgcctctgcctaggtaatttcccaagacccagaaggggtgaagggtgaggtgtgattgcccccacctccttgcctcccgcagcatctgctccgggaccatgaacaatagctgacagctccatggcccttgctgtccccatctcagcttccctgggcatctaaacctcagytgccatggggtaggaggacaggctgaggaagcagaagcctgaggctgtctagagtctcactcctgcatcagcaggccaccacctgtggttcctccttgtgcaaatttgaaaagaattgcataaaacactggagaaatccaagaggggaagtccacaagggcggtggctccctacaaggtcacagagcaagctggtgtcagagcctggacctacagcgctgttggtggaggtcctgcctccaggtaggggaagggctccctctcacctctacacgcagcgcatttcttggctcagctgccctgtaggggatgcagggtggggacagcagagatctgggcctgggagggagagagtacacaatcacatggctgttgcccctgtctcaggccttgtctacctctgactgtggctctctggcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccaggtgagggcagcctggtgtaggacagcatgcacacaggtcagagggtgatggcacgagcaatggcaggtccagtgtggtcagaaccaagggtgccgctgctgacaaggaaggggaggggcggccagggccaccatgccacaggtaaggccactgaggcagcttggggaatatgagctccaatttgaactccaggctcaggagtgtgcttgtatttcattcctctggtctcctggcctgctccctacaaggtttcacattcccagagggctggggatgtgcctagggagagactgtggcgtggacacaatctgtgggttaaagcgaagacaggacagcctggaagccccatgacatctgagtcactcccaacattccatttgcttatttttaaatcggggttaaaaaaaaaaaacaaatacataacatacattttccactttagccatttttaactgtacggttcagtggcattaggtatgctcatgtggttgtgcaaccatcaccaccatccatctcctgacctctttcattctccaaaactgaaatggaaactctgtgcccaccacttcatttgcttttcagaaccttctagagcacatcctccttgccaggaaatggtgtggatgtagacctttgagagagacagatgactatcattctcagggccatgagctatatgagagtgatgatatttgttgagcccttactatagcaagggagttcttctcattgtactcagtaactcttttggaggcaacaacccttgaccctgacaggcaggacccatgtctgccaaaccctaagacccatgatgtgcaaggggtcttgcaggaagaccaagagttggaacatccaaggaaaagcaagtgtgaagtcgggctggcagggaagcatgttctgtgtcagccggcactgggcgtgggccagggtgtgggaggtgggtaggtctggctcccctcccatggatttccctattgtttctcctgggtgctcaggcctgtcacgcctctgccatcacttgaccctaggtgcaagggttcagcccagaaatkttatgcaattgattcatgatttctcaggttttctgagtcctggcctagagtgacttcccaagaaaaamctccaccatttctgcttgtcttacctgccttgtatttacctttctaggattgccttttccacatttagtcaagtctaggttcagacccacgtgcaggctatagctccttcgttctccaccactctcaggatctatctagagtctccccacctggacctccagaccctgggagagccagaccagccccttgacctccaccctcccccacaacctgggccaggttcctctcctccctgtcctcagttataattttttttttttttaatttgaggcagagtttcgctcttgttgcccaggctggaatgcaatggcatgatcttggctcactgcaacctctgcctcctgggttcaagtgattctcctgcctctgcctcctgagtagctgggattacaggcgcctaccactgtgcctggctaattttttggtatttttagtagagacagggtttctctgtgttggtcaggctggtctcgaacttctaacctcaggtgatccgcccgcctccttaaatcttaacctcactgtttaccatgggtgtagcttacttaaactctgtaaaaatgggggtaaggattcgtactgggttgttgagaggataaagcgcaaaagcctcagggactttgcacctatggttttctatgcctagagtgttctttgtctcccttctacacacagcccacccacccactaaaaccataccctccctgagggtagaggtgttatttgttttcttcactgtggtgttcctaggacctagcacagtgcctgatgtataatcagcactcagttaatattggctggatgcaaaatgaataatataaataagctgaataacatgaaataggccgaacgcggtgactcacgcctgtaatcccaacactttgggaggccaaggagggtggatcacctgaggtcaggagttcgagaccagcctggcaaacatggtgaacccccgtctctactaaaaatacaaaattagctgggcatggtggcacgtgcctgtaatcccagctacttgggaggctgaggcaggagaattgcttgaacccgggaggtggaggttgcagtgagccaagatcacgccactgcactccagtctgggcaacaggagcgaaactctgtctcaaaaaaaagttagtttaataacatgagatcactttttaaaccgttaagagctgtactactaataattactctctcagacagtggctctccctcatctcctatatcccgtggattaccctctgttaaaagccaaaattaagcaggcatggtggctcacgcctctaatcttagtattttgggaagctgacatgagccaaggagtttgagaccagcctaggcaacatagtgagaccccatctctacaaaaatactttatattagccaggcatggtggcatgtgcctgaattccagctcctcgggaggctgaggtgggaggattatttgagcccaggatgttgaggctgcagtgagctatgatcacaccactgcgctccagcctggtcaacagagcaagaccctgtctcaaataaataaatgaataaatagggcggaaagcaccaatattgtaattgcctccgtccccaggtgggagctcctcaagggccctccccaggaagtgttcctctggatgacctacctggggcagaggagccagaatatggaggagatggctgtggtggggagagacttagtcctgtgtcttccccacccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtatgagtgctgttcccacaaacattaacctcagcagagggcggagcctgccagttgctggcagggagggcttggtccaggaattcgggtctgagggtggtggacgccctgccccctcccacagctctggtccccttcaagggtaaagctgctgagatacgtggctgacaggagtattctgtctcctccccactcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcaggtgaggacctgaggagataagatgaggagtgggagtggggctttggggttgggaggggtgcggtctggcccagaagctaagggtcttacgttctcctccctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatgtgtcttgtgtcttgtaatttcgggacgagtgggttggagggacacattgcttcatcttttccattgacaggccccaaattgggctggaactagcctaatgttcactgggaaggagggtgtgggggttgagctagaatccaggtatctgatccgttagtctgggtctcttacccctgcactggcttccccctcatgccaagctcatcccaccggcactacacatggagaaagacacagacggagtgaagaagggcagagatagccgatgagttattgggcttcaagttgggaagagagtttctttagtgatgtgggctgggtggagatattggtggggaggagggtcttgatgaacacttgccttgtttccatttatttatttatttatttatttatttatttatttatttgcgacaggaatcttgatatattgcccaggctggtcttgaactcctgtgcccagacaatactccctccttggcctcccagagtgctgggattataggcatgagtcactgtacctgacctgctttttaaaaaaaaatgacaactaatgttgcaattaacaatcttttacttagtggaatgttatacttaaattccagaaaggattattgggtcaagagtacatataattttgagagttacaactttatgggggttgtatcaatgtgcctcccccaccagcaaagtatgagagtgcctctttctccactgggtgtgatggctcatgtctgtgatcccagcagtttgggaggctgaggcaggagaatctcttgagcccaggagttcaatatcagcctgggcaacatggtgaaaccccaactctacaaaaaactaaaaaatcagctgggcatggtggtgtgtgcctgtagtcccaactactagggaggctgaggtgagagaatcgcttgactcccagcaggctgcggttacagtaagctatgatcatgccactgcactccagcctgggcaacagggcaagacattgtctcaaaaaaaaaaaaaaaaaaagagagagagagagagtgcctgtttctccacaaccttgtcaacccactatgccattaaactttggttttctgctcatcttacaggtggggaaagggcagctcagtgcagttttcatctgccattgttctgagatctttccatattgacctattgatatgttaaattaccaggtagtaatccattctaggtgtacattacattgaattcagtctcctactgatgggcattggaaggaatggggttcttttatgatcctgacattgctgaaagccacaggccagttatttagtagaatactcctccatttgggtttgtctgtttcctcatgattcattgaggttatgcgttttgggcacaaataccctacatggttatcccgtgcatcataatgggaggcatgtggtgtggggtttgctcattcctggtgacgttaactttgatctttttcttgagattgtgtctgccaggtttctccactacactttcccctttgtaactagcaaatatgttgtagagagagactggagaactagagatactctattcatcagcacacttccacctatatgttctagtagctgatggaccttaaacatgtcttactatgttacagctctttcaccaacccttcaatacttttcagtggtatcaactgtaaaaaccaaacttcttcacaatagcacagaagaccatgcccctcctttgagccctcaagccaaatctctcccacaccaccccataaatgagctccagtcacatttctcatgttgggggtctttgctccagcaactctttctctgcatgcctgaaatgttcttcattaatcctctgcagcctagcactttgtggccacttagatcacaacctacaatccccccctaaaatgacttctgaccactcaaactgacaaacccacccagctgatttctcatcacactactctatgtccttgtgcagatttttatctactgtgtttgttgtcagccttttccctaacaaaacatactctcccgaaagcagggttgtgtctgtgtcattttatgctacatccccagggtctgggtcagtgcctggcaccgagaatgtgctcagtaagttaaggaatcgctgcatccattctgtcagtcaacaattccttctgagcatccagtccactggcccatgctggtctcagccaacagaaagggaattgagttccttgcaaggtctggtggggacagacagttctgagaaccagtgactcttagaacaaggagatgaggctttcacagagggaagcacagagtgtggtattattctgctgaagcccaaagaggtcagggaaggattccaaaggagtaatgtttgccaagcacaaaacagcacagggaatggcattccatggacaggtctcagcaagtgcaaaggcttagaggtaatagaagtgcaagcagaattccagggtggctaagagaggttgtgtggggaatgggcagcagttaaggccaaagaagaaacactggatctgcattccttaggacggtgccctgtgggcccctcacagagcttctctcctgcaactgctaggtataagaaggcaggcttagaatcggactgagatcagtagtttctgcagctgggaagatgagtgaggtgagattgcatgtgtgataggctggcactcagggaagacctcagggttctctcctccccactctgaggcccctctcctgcttcctgaagcccagagtctccacctctgtgagccaaacaccttcctgttatctgcctggtcctagggtagccttcgggttggggttagaaggaatgccaatggttaaccttgtggtattaagcttccagctcaggcagatactctctggactggttcaagctgactgcctgactgtccctccctgctggccctagcacccagactccagataggcacaccacctcacccttcagagcagggctctgagactccacaagtggtgaggacttaccagaggaactgaacttgacctccaacccaaccttccatttgctggtattattctgaagccctcatggcccaggggcctgcctcaggtagcaggtctcactcctgcagtggaggggccataaagttcagttcatgatcagcccccaagccaggggcagcggatgacagggcaggagttccatctagaggagctcctgtgttcaggcgttcctagacacctgcctgcccttctcccatcagcactggggtataaagaaggaaagaggcctgaggtttccagaggcctctacctgctgaggtcttaagaggactcaaccctctgggaaatacaaataaaatcctcaaccctccaaacaactgaatggacacctcttggccaaagagaccccggaaaaactttaaaatccaagtttcctggccgtgatgataggtcactcacacctcagcacacctgcttcctcacgaaccgttaccaggcttctttcccaagagctaaacagaaaccagccctgaaaaccaagaacaggagactccttcactgatttcaatttcaaccaattccgagactcccttccctttcctgattttgacatgacagctgatcagcttacaaaacattcctggctgatcaatgactctcaaccatggaccagttctggctggtttacagaggcagcacacaaagtgctttgggtcctgtgtttcacattttgacatacagagcctaattcaactgcattttaatgtctccaccccgaagtgaatatgggacatatttaacatgttttattggtacacatgtgtgcaactctcatgaatattcataaatcctcttaaaacttattaaatatatatgtttagccaactgatttagtgtaaaacccctgtcccttcaattcctagcttgtaggttgcaacccatcaaaagaaataaagctctcttttccaaatgtaaagatcttatgattttaagccaatataattgaagacaagagtaggatccatggagcagcccaggttcccccagcctaagtgaatgcacaggtgccaggtggagccattgacagctcatttgtctccctgacagctttgggaggaaggtgggtaagctctccccgatctaagatctctcacttttgaattgagatctcgaggacttcatttttttaccctgatcccctccatccggaccctgcaagtgccatctttgttggtcccaggtttctagatggggaggttgggggcagttaagcctgactcatccggcgcatcagcccatcaggtttggtgaggatgcttgccctctagtggcacacgaaggaatgtcttatgcttttctggggaatctagattctaaggagacagtcccagaccagctgccatcaggaacatgcatgtttcagaattatgagaaaaagtcttgtgaatattttggatcctggaaaaaagctaacctggaacaatataaagatttataggccaaaatggagaacttttggcagaatgtctgacatgcctaaattagtttatttgcatgcacaatagggttcaggacctctcagaagcaatgggaggtcttttttttttttttttttttgagacagagtctcactctgtcatggggagtggagtggagtggcacgaacatggctcactgcagcctcgacctcccaggctcaatcatcctcccacctctgcctctcaagtagctgggattataggcatgcaccaccacaccccactaatttctttattttcaatttttaattttttatagaccatgctggtctcaaattcctggactcaaggaatcctcccacgggagaccatttttcagtgttattatgagagctctaaacacagttgggagtctcagataacctccttaaatgagactaattcaaaactgaaggagtctaattcaaaacttgaccagcatattcaaacctatctgccactattggacaggtagctgaagacactgcaaaaagccttatagcccaacaaattgaattccctggctcaagtagtaatagataatttaattgcttcagattttcttttacccaaacaaggaagagtctgtgcagtggcccataacacctgttgcacttacatcaacacttcaggtgaagtagaaactcatatagggttgggcacagtggctcacacctataatcccagcactttgggaggctggggagggaggattgcttgagctcaggagtttgagaccagcctgagcaacatggtgaaaccctatctctacaaaaactgcaaaaattaaccaggcatggtggcacatgcctgtaatcccagctatttgggaggctgaggcaagaggatcacttgggcctgggaggcataggttgcagttagcctagatcacgcaattgcattccaaactgataaagcaagactctgtctcaaaaaaaaaaaaagaagaaaaactcatacagaaagaatttccaaacaagctaaatgattacaagaaataaaactactgatcctatcaatgatctgttcagttggctttctaccaaacagaaattcctttcaagatgctattgaaggctgggcgtggcggctcatgcctgtaatcccaacactctgggaggctgaggcgggtggatcatctgaggtcaggagtttgtgaccagcttggccaacatggtgaaaccccgtctctactgaaaaatacaaaaaattagctgggtgtggtggcgacacctgtaatcccagctacttgggaggctgaggcaggagaatcgcttgaacctgctaggcggagattgcagtgaaccgagatcacgccactgcactccagcctgggtgagagtgagactccatctcaaaaaaaaaaaaaaaaaaaaaaggtgctattgaagtttttgttataattatagtctccatcaaacttttcttcataacatttaaattacttataatatgggacaggcatgggggctcaagcctgtaatcccagcactttgggaggtgggcagatcatttgaggtcaggagttcaagaccagcttggccaacatggcgaaacactgtctttactaaaaatacaaaaattagccgggcatggtggcatgtgcctgtaatcctagctactcgggaggctgaggcaggagaattgcttgaacctgggaggcggaggttgcagtgagccgagatcacaccactgcactccagcctcggcaacagagggatactctatctaaaaagtaaatataaataaataaataacttataatatgtataaccaactgctgtaagtctgctgctaaaaccagaattatgctggctcaatgcatagaacttatagacaagttaaattggtagccctaccttttggcctttatattgcttgatagaccttaggggttgatgagtacctgcccacctctatttctgtctggccaagatgttcaattggctgtaagtctcttggccacaagggtcccaccaagggactggatggatctggagcaggtagcctcagcatcctggcaacgacatggtacaaacaatttggccattgatgctgactgtggcagatcttggctaaaaggaagaaatgtggaataaaaagaaaatccaaagacccctcaactgactgaacaaacccctcttggccaaggagaccccagaaaaactttaaaatctaggtttcctggctatgataagacaggaggctggtcacacctcagtataccctcttccttactgttaccaggcttttttcctaagagttaagcagaatcctgtcctggaaaacagagaatggaagactcctccgctgacttcagcttcaactgcctgatgccatggccagacttcactctctttttgtgatttgacacgacagctgaccagctcacaaagctatccttcctgatcagttcctgttaaccatgggctggttctggctggtttacagaggctgcacacaaagtgcctttgtgtcctatgtttcaccttttgatgtgtatggcctaagtctgcattttaatgttaagtctcagctgggtatggtggctcaatgcctgcaatcctagcactttgggaggccaaggcaagaggattgcttgagcctaggagttcaagaccagcctaggcaacatggtgagaccttgtctctatttttttaattaaaaacaaaatacaaatataaaaataattactgttaactctccaccccaaagtgaacacaggatgtatgtaacatgtatgtttgcttagtatacatgcatgtgactccctttcatgaatattcatagctcctcctataacttattaataagtatactagctaacctatttagcataaaactcctgtcccacctctcctccctcaaagtgcctgctttccatctcagccagaggctccacttcccagcctgcaggttacaacacaatattagtaaaagtgttctttccaagtgtatacatctggtgattttaagttgatacttcccaggttgtccaagattcaggtacagctcactattgcaggatacaagctgggatctcctgggagttggtctctttgcaaatcgtattatctctgtatcaccttttatgaaatcctaaaagaatttaaatctgaaacatgtgactccaaagattttgaataaggaattgtgaacccatggtaaactcctggcttaagggtgtccaattttttggcttccctgggtcacattggaagaataagaaagtttaagaaagtctgtgaatttgttttggggcacattcaaagctgtcctggccacatgaggcctgagggctataggttggacaagcttctagctggctatttctgcattttgtccaaatccatcttttaattattatcattattattattattatttgagacggagtctcgctctgtcacccaggctggagtgcagtggcgcgatctcagctcactgcaagctctccctcccgggttcacgccattctcctgcctcagcctcccgagtagctgggactacaggcgcctgccaccacgcccggctaattattttgtatttttagtagagaaggggtttcaccgtgttagccaggatggtcttggtctcctgacctcgtgatctgcccacctcggcctcccaaagtgctgggattacaggtgtgagccaccgcgtccagctgaaacataatttttctctttttggtttcacatttttactaaagacaaatcatggtaagactgatttgctttattatacttggcctgattatttgtgtaacgtgcagcaagaatacttacttttcacataggctttttaagttggctttgatggaactttgttttgtagaagaatctcagattagactttttcttttaaggccgggctcaggggctcactcctgtaatcccagcactttgggaggctgaggagggaagatcacatcaggagttcaagaccagcctggccaacatggtaaaaccccgtctctactaaaaaacaccaaaaactagccaggcatggtggcaggtgcctgtaatcccagctacttgggaggctgaggcaggagaatcacttgaaccttagaggcaaaggttgcagtgagccaagatcacaccattgcactccagcctgggcgacagagcgagactctgtctcaaaaaaacaaaacaaaacaaaacaaaactttttttttaaagccgagtttggccatgcggttgtaccatcaaatacctatgagttgggtgaattcctcttgagaacccaagatgatttggggctcctgggtctgtcagagagtgacattctttacttgccacaggtcagaaaccctgctcaggatctgtgtagaaaaggtatgaagttagttttcccaaggggctcttatcagctctataagtcaagtttgattccttaaaggaaagcacaccattccagtcaaagccttggtaaaataactggtttctccaattgtgtcctgttacaaaagaaaacagattctggctgggcacagtggtcatgcctgtaatctcagtactttgggaggctgaggtgggcagatcacttgaggtcaggagattgagaccaacctggccaacacggtgaaaccccgtctctactaaaaatacaaaaattagctgcttgtgttgtgtaattgggtaataagagattttaaagaattttttttgtagagcaccatggtttaaagtcagcttaattaaaattagatattcaagctctaacagcctgggactccttggggaaaacaggaggcgccagagacaccattttggaaaaaaaccctgttttcctcttggaaccccaggaattgaaagctgataaattcctctcaaaatttaaggctttgttctgttttggattgcagtatctgaagtttttgacttttggtctatcagaaattatatcgcattatgagagagttttggtgtgtaataactaggtaggaaatatactttaaggaatggctaatggaaattatagatgatcacgtagctctttgcatgtttggattagagaagcatgctcttggccacctggaaggtatggaaataccttttttttttttttttttttttttgagacagagtctcactctgtcaccccggctggagtgcagtggcaaaatctcagctcactgcaatctctgcctcctgggttcaaaggattctcctgcctcagcctcccaagtagctgggattacaggcacctggcaccatgcccagctaatttttgtatttttagtagagacggggtttcaccatgttggccaggctggttttgaactcctgacctcaggtgatctgcctgcctcggcctcccaaagtgctgggattataggtgtgagccaccgtgactggctggaaatatcttcttatctcccactgagagataagacttccacagaagatgggctgattcccccttttttggggagggatccagggtctggtataaaatgggatcttcattttgggggatctgttttgccttccagctgtgcctgcttattagggccaaaggtacttgggagtcccagctatttgggagactcaggcaggagaatcacttgaatccaggagatagaggttacagtgagctgagatcacaccactgcattccagcctgggtgacagagttagactctgcctcaaaaaaaaaaaaaaaaaaaaaaaagaaagaaagaaaaaagagacagattatttagattatttatttacttactttttttttgagatgcagttttgctcttgtcacccaggctggagtgcaatggcacgatctcggctcactgcaacctctgcctcccgggttcaagtgattctcctgcctcagcctcctgagtagctgagattacaggcacacaccaccacacccagctaatttttatttatttatttttagtagagacagggttttgccatgttggccaggctggtcttgaactcctgtcctcaggtgatccacccacctcagcctcccaaagtgttgggattacaggcgtgagccactgcgcccggccaagaaacagattcttattgcacttatgcaaataactatattgctataagttaagaatactcacacctagtttcctaattctggaaaaatcaggtagaaaaaaacaaatatgctccaaatatgttgccagaagtatactttactgaattgtttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgctcccggctaattttttgtatttttagtagagacggggtttcaccttgttagccaggatggtctcgatctcctgacctcatgatccacccgcctcggcctcccaaagtgctgggattacaggcgtgagccaccgcgcccggcctactgaattgttaaaaggtgtaaatagctcaaaatttttcctgactctgaaaacaaaacaaagtttcagcagcattttaagcaaagtcaaaaacatttcttcagtcttctatttgttcattccatgcagttaactcctgtcctgtttaatcgtcatgaacatttcagctgtccatgagtcctgaaagtttttcctctattctgacgtcacaatctccaaacttatcagaaacctgcattcaagagaacctgtcaaaatcctatagttgattataaaccaccttttgaagaggatcaaaataagaaaacaattgtctgtggttgacagaagtcttaggacagccactatttaagccacaattgaaaaggaaatgtgggggtgggcacggtggctcacgcctgtaatcccagcactttgggaggccgaggcaggcagatcacctgaggtcagggatttgataccaacctggccaacatggtgaaaatccgtctctactaaaaatacaaaaattagctggggatggtggtgggtgcctgcaatcccagctactgagagtctgaggcaggagaatcgcttgaacctgggaggtggagttttcagtgagctgaaattgtgccactgtactacagcctgggtgacagagtgagactctgtctcaaaaaataaaaaagaaaagaaaaggaaattttggttagttctgtgacaacaattttacataacaattatgactattaataacatacactaagttatcaaggaattatgggtgttttccataattttggaacatgtccaataacatatttatgcaaatataggccaaagaaagccaaatactatttcacatttgacgatgcttcctttatggattttatactgaataagccaaatttcacctttacgttagtgtactattaatgttaaacccaattctttaataaaaccttttagacaaatttatttaatcttaatcagtttgaccataaagtaagattcttataaacttttgtttcctcacctccccagaaaagtggatcctaaaccttttataaccctttacaatttttgtgaacgagcagattaatgctctaagaaaaacctgttgtgcttttattccaatgtttgatttatagaaaaaatgaatacccctttaactttagccaacatgttcacacagaatttcttttatgacattaatttttcacaaacctcccacaatttgttcaagccttcagctttatctcatctaaaacaatcctttaaccctttaatctaggcagaaaaatccacattcccatgacttcttataatcttttaccaaaaacacatttcactttccttacacaccttgcatgtaaaactgatgttatttcccaaagattactaaaggcatataaactaaaaggcatcacagtttttatttttctaataaaatatttgatttaagctcttattattttttaacctattaatcaaagctcttttatatctcacacacacaacatatataaatacacagaccagaagatccagtagttgtaagaattttcatttgccagtttctttttctttctttttttttgaatcggagtcttgctctgtcgcccaggctggagtgaggtggcttgatctcggctcactgcaagctccgcctcccaggttcacgccattctcctggctcagcctcctgagcagctgggactacaggcttctgccaccacgcctggctaagtttttgtacttttagtggagacggggtttcactgtgttagccaggatggtctcgatctcctgacttcgttatccacctgcctcggcctcccaaaatgctgggattacaggtgtgagccaccgcgcccggccatcatttgccagtttcttaattggattactgactttagggtggagcccttgggggaacaaggtcaggaaagcatgcagtttctacagcctaataagcaggcaagctggaaggcaagacagatcccccaaaataagggtcccattttataccagatcctggatcccccccaccaaaaaaggggaaatcagcccatcttccgtggaagtcttatctctcagtgggagataagcgggtatttccataccttcgaagtggccaagagcatgcttctctaatctaaatatgcaaagagttaagtattcaccaataacttccactggccattccttaaagtatatttcctacctagttactacacaccaaagctctgtcataatacgatgtaatttctgataccaccaaaagtcaaaaacatcagatactgcaatgcaaaacagaacagagccttacattttgagaggaatttgtcaactttcaactcctggggtttcaagaggaaaacagagtggtattttttttttttttccaaaatggtgtctctggcacctcctgtttttcccagggagtcataggctgttagagtttgaatatcctgctttaatgaagctgacttttaaccatagcactcttaaaaataaaaatcctttaatgtctcttattacccaacttcagccatgccaaactaccaatatttctggcttctgaactttaccaaaggcaaactcccaggtactcggagaaaaaaaattcaagacagtttgtggagggaaagagaatctacaaatgttcagacagatctcaaactagaaaggactcattccctaagctggggattgaaccctgaacctgggctgccactgtgaaaagacagtcttagctgctgagctacagcattgggcagtctccattgcccttcccagaaggaggctagagtcaccaattttgagcttgcaaaggcttttatctgatcaagataatttttaggagtaactatggcatgaaccccaaaactcctgtctgctggatggtagaaacgaagagaaagtatcgccacgtggttacaaggtgaagctcccaaggacataaaacaagacgaaagagaaatttcatccagcttttcagggaccttcagcaaagtttataactgatcagtttgcttggccattttgaacagcgggcttacaggcgtcatagtgagagacaggactagctggatatcctaggcctactaagaatccctaagcctagctgggaaggtgactgcatccacctttaaacacggggcttgcaacttagctcacacccgaccaatcaggtagtaaagagagctcactaaaacgctaattaggcaaaaacaggaggtaaagaaatagccaatcatctatcgcctgagagcacactgggagggacaatgataggatataaacccaggcattcaaaccagcaagggctaccctctttgagtcccctccctttgtatgggagctctgttttcactctattaaatcttgcaactgcacactcttctggtcagtgtttgttacgactcgagctgagctttcacttgccgtccaccactgctgtttgccgccatcgcagacccgccgctgacttccacccctccagatctggcagggtgtctgctgtgctcctgatccagtgaggcacccattgccgctctggattgggctaaagtcttgtcattgttcctgcacggctaagtgcccgggttcattctaatcgagctgaacattagtcgctgggttccacagttctcttctgtgacccacggcttctaatagagctataacagtcactgcatggcccaagattccattccttggaatctgtgaggccaagaaccccaggtcagagaacaagaggcttgccgccatcttggaagcggcctgccactatcttgggaactctgggagcaaggaccccctggtaacagtaggcttgcattctatcctaaggtacccttctttatggcagaacaatatagacacacaaagcacaccagattcgttacagcttaaggctagcctcacaagtcttttttctcattaaccaaaacttgcctgtggtaaggtggggaaagtgaagagctcaggaagaccagagaaagactcacctatcccagtgacactgaatcaaaagttcaggcagccgctcattggttaagaagggatcttttccaggagttgcatcagctcttaagtgtccccgtttggggagcaaaaagctctcatgtcccaggatcctgtacatacacaattctgtcacccacagccatcagcaaagatttcaaggtagattaatccaaagagaatagcaattaatatcccatggtgctaaatccgttcttagccaagaggaactttactctgagaggggcttctaactccctaaatcttagaagggactctaacactcctgagttgggcctcaaaccaaagttcagtcaagtgtccttgccttttattaagaggggcctttaacccactctgtcttaggagagactttaactcccctaagttgagcctctaacccaattccatcctttacctgggtaccccgccacttaccctagatagccaattggtgctgcagtctatttcctttgggtagggtgtctcctcagggttcgacaggaagatgttaccagaaagggatccagatccagaccccaagagaaggttcttggatcttgtataagaaagaatttggggtgagtccatagagtaaagtgaaagcaagcttattaaggaggtaaaggaatacagaatggctactccataggcagggcagtggcttgagctgctccactaaggatacttattgttacttcttgattatatgctaaagaaggggtggattattaatgagttttccaaggaaggggtggccaattcccgtaactgagggttcctctcctttttagaccatttagggtaacttcctgatgttgccatggcatctgtaatcacggcactggtgggagtgtcttttagcatgctaatacattataattagcatataatgagtgatgaggatgaccagaggtcactttggtcgccatcttggttttggtgggtttgggctggcttctttaccacaggctgttttatcagcaaggtctttgtgacctgttatcttgtgctcacctcctagctcatcctgtcacttggaatgccacacctcctgggaatgcagcccagtaggcttcagcttcattttacccagcccctattcaagatggggttgctttggttgaaacgcctctgacagacccaccagaggagcccttcagtttgtattaatatgatatgtgactacttatttcacagacactgtgtgtcaaatgtcggtacaatgccaacaactcactttcttggttgttgagtttccgcattacacaaataaggaagcaggcccagaggagagcctgggaaatgaagttggagagacccatcctggggttgcttgatttagggatttagactgggaatgactcctccatagatctgaaagaagaaactgcacactgttcatagtggcttcttttctgccagccctaaacagctcaagaaaggagagtctctcagttatgaggctgggtgtgaagcattttttttttctttgagagaggtcttgttatgttgcccaggctggtctccaaatcctgggctcaagcgatccttccaccttggcctcccaaagtgctgggattacaaatgtgagccaccacatccggcctgaagcatcttggttcatgcatctagcaaaccttcagtctgtgtctctcaatcccactggacatgaggtctgcctataacaattatttggctacaacccctttaatatcctgaacttagctaaacagttattttaaaaatccatattcaaatataactaaagaagaaacagaggaaaagtaatttgtaatatggatttctatttatattcgttttgactccattagcagatagcagtcactgccctgtttgcacttgttttgaatcagtgagcctgtagctgccaagtgcagactaacaagaggtaaataacctgtataccttgagcagctctgactttaacttattcttttattttttatatttttatttttttttatttttatctctttttagacatgaggtctcactatgttgtcccagttgacctcaaactcctgcactcaagtgatcctcccaccttggcctccaaagtactgggattataggtgtaaaccactgtgcctgggcttttatatattttttaagtgcacattttaatgtttagcttgtcagccttaagtaacgagatccagaaagcttgaggatagctacacagaagcatagattcaagttgtcctgaatatacacttcgattcacagcagttacaagtgagtttttaaggaaacagaatagttcctaagttgtttatcaagaatttaaaataaaataacataagcaattcattggctatacattgttttttgtatcacaaattccaggaacagataacgggtgaggcagctagtcagggacaaaacgccttggaacaattgtctctgggcatgggtggggagggtgtgactgaagttccatactcatgcctttctgggcctgataaattgggcatgtctcacatcatgagactgctctgagctatttttcttttctcaagctttataccaaattctaggccgtgggctttcattcattcaataagtatgtattgagtgtttatgtaatcggaactcttctggggttacaatttaacttactttctcacctccgaatggttatcacctcaacgaggactaaatccaatgatttttttttatcttgccaaaattcctatctaaggggtctggggagtcatgccctacaaatcataaattctcatcagatgggttttatttaaccctatatatcatgacttactttccaacctgactctggcataacatgacgagacaaggaagaaaagcaaaatattttaatatttttacctcaaaacatgtttctttgccatatcttgaaatggccctgctactgtcctttgtgggggaaaattttcatctgtaaagaatctctattaacatagctggatctttttctaccaggcccttccaatcataaagagattaactaagtgtagcaccttttatagatctgaataggaaacacttgtcatctgttgtttctaagggcagccactataagacttcaaaagaaccttggtctccacagtcttttatcttaacatttcttttctatcaaccccaggtctttagacaaactcaaccaattgtcaaccataaaatgtttaaatttacgtatagcctgaaagccctgccaccccactttgaattgtcccaccttcctggaccaaaccaatgatttttttttttttttttagatggagtctccctctgccgcccgtgctggagtgcagtggtgtgatctcggctcgctgcaacctccgcctcctgggttgaagcaattctcctacctcagcctcctgagtagctaggattacaggtgcctgtcaccacgtccagctaattttttgtatttttagtagagacagggtttcactatgttggccaggctggtctcaaactcctgacctcaagatcagcctgccttggcctcccaaagtgctgggattacaggcgtgagccaccgtgcctggccaatgtattccttaaatgcatttgattgatgtctcatgcttccctaaaatgtatgagacatccttctcccctgattgttttcaaaagcagtgatccattgaggtgctcatttttgtaaccccagttactagaaaagtgcctgggtaagagtatgtaggatctctataaaagctgaattaacgaattttgtaatgactgcacctccagacaggagctgtcttccgggcttccacagtctctgacagccctctcccacaaagagtttaccaacagcaaggactttcctggatgacttccactgggttggggattaaggattgaaaggggagaggctgggtgtggaatattctggctgtgctggctgtggacttagtcctgtgtcttcccgcatccagtgtagtctctggagaaagaatgcctgagctttaccagcaccacccaggaagcccataagaatattcccatctatatggattcaactggaaccactgtggagagatggtacctgcctgcaaacggcactttatccaggacacctgcctttacgagtgaccccccaacttggggccctggatccagcaggtacgcatggcttcctggcatccaagagctagcagaggagctgaattttccaggcgtctctgcaggcagcaaccccagctccagttctattcagggctgggttcctgggattcttgagcctgagcccttcttttctaccaaaatctcccaggtggatcagagctggcgcaaagagtgggtgctgaatgtgcccctgtgcaaagaggactgtgagcaatggtgggaagattgtcgcacctcctacacctgcaagagcaatgggcacaagggctggaactggacctcaggtgagggctggggtgggcaggaaaggagggatttggaagtgaaggtgtgtgggtgtggaacaggtgtgtgacattttggggttgtagggctggcagaatcagagaccctttggggcccagtggctaaaggtcttccctcttccctacagggtctaacaagtgccaggtggcagctgcctgactacctttccatctctactttctcacacccactgctctgtgcagtgaaatctggactcactcctacagggtcagcaactacaaccgagggagcagccgctgcatccagatgtggttcgacctggcccagggcaaccccaatgaggaggtggcaaggttctatgctgcagctctgagtggggctgggccctgggcagcctggcctctcctgctcaacctggccctaatgctgctgtggctgctcagctgacctccttttaccttctgatacttggacatccctgccctgtttagccccacagctcccaactatttggttcctcttctatggtcttgtctctgacagccactttgaataaaccagacaccacacatgtatcttgagaattatttgggtatgaatgggaatgtggctgttttgtttcccatttcttattgattgaagccagttagactgggctagttcccagctctgatgcttgctatgaactagcctgatacttaagtattcttctaaggtaggagacatttgtagctctcgattttattattcactatagctccaatttagagccaagcccaggcatttttctttttttgagacagggtctcactctctcacccaggttggaatggagtggcatgatctcagctcactgcaacgtctgcctcgtgggctcaagtgatcctcccacctcagcatcccaaatacttgggactacaagcatgtgccaccacacctggctaatttttcaattttttgtagagaggaaatcttgcaatgttgtccaggctggtctcaaactactgggctcaagcaatcctcctacctcagcctcctgagtagctgggtctacaggtgtgagcctccacattcagctaatacatataatataaaacatgtattatatatgtaatagtagagacagggtctcactattttacccaggttgttctcaaactcctgcgctggagtgatcctcccaaaatgctgggattacaggcatgagtcactgcatctggccacaagtcatgtttatttcttgctcaagctacaatgctgaatgtgggttatcagggggattctgtttatttctcattcctggactacattagcagccagggggttctgcttctcactcaagaacccacgctgatggaggctccatcttccatgagacaggaagagggaacttggcaaattccataaggctcttcaaatttccacccatcacttatttcattggccaaatcaagtcatgagcatgcctaaattcaagaaagccaggaaaacataatcctatcatgtacttgcaaggagaggggaatcacaaggtttgcaacagacctaatcatgagtaaaaagacttcattattttctcgtagatttctgtttctggcatggtcatagttacaaatttaattttttggttagatcctagtaagaaggaggaccaactctctatacatatgcaaataactacatcaacctgaaaagtggagcaatccactgatgaccgccctggctagtcttgtaaacaaggccaattgatgccttttcgcccttcatttatttctatttattatttttattttttgagacagggtctctttctgttgctcaggctggagtgcagtggcacagtcatggctcactgcagtcttgacctcctgagctcaattgatccctcaactttagcctcccaagtagctgggactacaggcacatgccaccatgctgggcaaatgttttgtattttttttgtagagatggggttttgccatgttgcccaagctggtcttgaactgctgcgcccaagtgattcattcacccaccttgacctcctaaagtgctgggattagaggcgtgagacacctctgccagcccactgatttcttttttgaaccgaaagcatagttgatcaatgcaaaagctaataattggatattaacaaaattcaaaactcttgcactttaaaagacacccttaagaaaattaaaaaacaagcaacagactggaaggaaatatttgcaaacacatctgataaaggatctgtatccataaaatacaaagaacacttacaactcagtaacaagaaggcagacaacccaatcaaataatgggcaaaagaaatgaacaaatatgtcattaaagaaggtacacaaattatgaatagttacacgaaaagatgctcaacattattaatcattagaaaaatggaaactaaaaccatagtgatagacggttttatacctactagaatggcaataataataatgataggcaataacaagcattggcaaggatgtggagaaatgggaaccctcacacagtgctggtggggatgtaaaatggtacagcccttcggaaaacagtgtggcagtttctcaaaaagttaaatgtaaaactgccatacaacccaaaattccactcccaggtgtctactcaggagaaacgaaaacaaacataacaaaacttaaatatgaatattaataataatcatatttatgtatgtaaatatgatgtatcatttatgtatgtaaatatgatatatcatattatgtatcattatatataatagccccaagctggcaataacctaaatttttagcagctggtgagtagatagacaaaatgtggtgaatccatacaatagaagactgtgcagcaatgaaacgtgatgacacatgctatgtcgtggatgagcgtcaaaaacattatgttaagtgaaagaagccagacctaagaggcttcatgtggcatgatttcacttacatgaaatgtgcagggaaggcaaatttatagaggcagaaagtagattagtagttgcctggggctggaagtgacaacagggattaattgtaaatgggcatgaggggggataagaattgaggggatgattctgagtttctgtggggtgtatccatgagggaaagtattctaaggaaattggcatgtggctccataaaaatctatcatctgagacaaactccattcccatcatgaactttaaaatattggttggaagccaagcatggtggctcatacctgtaattccagcactttgggaggccaaggcaggtagatcacttgagccagggattctagaacagcttgggcaacatggtgaaaccccgtctctacataaaaatacaaaaaatttagcccagtgtggtggtccacgcctgtagtcctagctatgcaggaagctgagatgggaggatctctttagctcaggaggtagaggctgcagtgggctatgactgtgccactgcagtccagcctgggttgatagagtgagaccctgtctcaaaaaaaaaaaaaaaaaaaaataggaattgctggatggtaatgttgtaggagtttctcctcagttcagccaaagacagggtccttgtcacctggccatgaaatattaggcttgcagacactttgaagggtgagaaaaatggaatttattgggcaaaaaaaaaaagcggggaaacggggaccctcggcagagtgagagtcctgctagtacacgcttcccacctctcaggttgaatcccaggttccaccctggaagaggaggggccaggctcctcagcacgaacttccagaggctccaccccagtgcacattcctcccagtgtgcgggtttgtcagaggttctctggggacccctttacacttggctgtctcattcccccctctcaagaagtacatcaaactactgttagaacaaggataggggtgaggacgaagaccgatctaaactgcttcctgctaacagggagcggtgttttgggaaacggcagtcagagctccctcagaagcctatctaagggttcccggcagaaggcgccatcttccgaggctccggttgcacgaccatttggagtttgatggcctgaaggcaagaggagaaaaaccaggttattagaaaacatgtgttaaaacgaaacaagggagggtaaggacagcttaaaatccctaggccttttaccagtttgcacagggagagggaaaccaaaagcccgactggtaaaaaaaactttacccttttgccagcatgtcatgcttgtgggttcccttcctctgagcccaatcctaagccaaccagctgaaggtttgggaaattaactctttccagtttggaggatgcatctgaggggagtgtcctatagtacaaagacacaattacctattagtgaagagaagacagtggagaagaaaggaaaaaaaggtgctttttaaaggagtcccaggggttcagcatgcattcaaaaggggtacagagtgaagatgaatggctacccatctagaaagaggggagcaggcatccctgtctcctatctctttctagcagataccaggggtacatgagggagagaaggaagagcgtcctctttccctcttctgtccttgcatacccaagtcctggtgaccttggcaggtgctgccatgggtgccacagcagcttgcacccatgaagcagggagtacctagagaataggaattatcagccagactcagtggctcacgcctgtacaacccagcaccttgggaggccgaggtgggcagatcatgatttcaggagtttgagaccagcctggccaacatggtgaaaccccgtctctactaaaaatacaaaacttagctgggtgtggtggtgcatgcctgtagtcccagctactcgggaggctgaggcaggagaatcacttggtcccaggaggcaaaggttgcagtgagccaagatcacaccactgcactccagcctgggcaacagagtaagactccatctcggggaaaaaaaaagagagaataggaattatccgctcttacctatgtttctataccccctacagtcagtagtcttggagtttcctagacctcatttatgctgtggggaaaagcaagagagatcagattgttactctgtctgtgtagaaagaagtagacataggagactccattttgttatgtactaagaaaaattcttctgccttgagattctgttaatctataaccttacccccaaccctgtgctctctgaaacatgtgctgtgtcaactcagagttgaatggattaagggcggtgcaagatgtgctttgttaaacagatgcttgagggcagcatgctccttaagagtcatcaccactccctaatctcaagtacccagggacacaaaaactgcggaaggccgcagggacctctgcctaggaaaaccagatattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttcccagggtccccttatttctttctctatactttgtctctgtgtctttttcttttccaaatctctcgtcccaccttacgagaaacacccacaggtgtgtaggggcaacccacccctacatatgccatggatactagcatgacctttatccatgaaatgggaggcttggcttgattggcaggaattagccatgctcacttgcacgcactgtgccttttttttttttttttttttttttttttttgagacagagtctcgctctgttgccaggctgaagtgcagtggagtgaactcggctcactgcaacctccgactccctggttcaagtgattctcctgcctcagcctcctgagtagctgggattacaggcacgcaccaccatgcccagctaatttttgtattttttttttcgagatggagtcttgctctgtcgcccagtctggagtgcagtggcatgatctcagctcactgcaacctccacctcccagttcaagcgattctcctgcctctacctcccaagtagctaggattacaggtgcatgccaccatgcctggctaatttttgtatatttagtagagacggggtttcaccgtgtttgccaggatggtcccgatctcctgacctcatgatctgcccgccttggcctcccaaagtgctgggattacaggtgtgagccactgtgcccggccttgcactgtgccttttaacccctgttatcatctgcctctgaatcccttagatccagttttctttcctggggctttgactcaaagcttggaatagaatttgaaacaaaaatatgtgtctaggaagggctgcatggactccttatcataagccaaatgctaaggaaggtgaagctgcagaattgagtcctcctccaacaagggagagaaaaagatgtcttgtgacatgcccagataattggtggctatagttatgtaagctaggatttgggtgcatggtgcttggctttggttagctcttactttccaaaaaaggaaacctccgattaatgggcatcctatttattcccatcacctggcaggatttgcaggataattgctcagaactaaaatattgatccagatttttacattacccatcctctccttctttctgagctgcagctggagattgctggttggttcacaggaacaaggagtgttagcctaaaaatgtaggcaaaaacttaaacactaatgactttagaatttattgacaaatgtatggtgttttgaaacataatttctctctctccagtcctcatttttgttaaaaaagcaaattatggtaggattgagttgtttgcaaaatagactttagtcatatacttggcctgattatttgcataaagtgcagcaagaataactatttctacataagtcttttagattggctttgatggaactctgttcttcaaggaatttcagacaaaacgttttaaaactgagcccagccatggatttgtatcctcaaatacctgtaagttggatgatcttctcgtgttaaggtcccatgacaaatttggagctcctagacctgttagaaagtgacattcttggccaggcgtggtggctcacacctgtaatcctagcaccttgggaggccgaggtgggcggatcaccggaggtcaggagttcgagaccagcctggccaacatggtgaaaccctgtctctacttaaaatacaaaaaattagctgggtgtggtggcaagtgcctgtagtcccagctatttgggaaactgaggcaggagaatcacttgaacctgggaggcggaggttgcagtgagccgagatcatgccactgcactccagcttggcgacagagcaagagtctgcctcaaaaaaaaaaaaaaaagaatactcacggataatttccaaattctggagaagccaggcagagagagagaaaaatatgcttcaaattttgttcacaggagtgtagcttactctagtattaaaggccttaaagagttcaaaataattttccttgactctgagaaacaaaacaaggatcagcaatattccaagcaaaagtcaaaaaggttgcttcagctttctgagttcagtccattcagttcttgttatgcttgatattcgtgaacattttagctcttcatgagtcctgtacattttcctttattccaatatcacagtctccaaagttatcagaaacctgtatttgagagcacctgtcagagtcctatagcttattacaaaccaactttatttttttttgagacaggatcttgctctgttgcccaagctggaatgcagtggtgagatcttggctcactgcaacctccacctcctggattcaagcgattctcctgccccaacatcctgagtagctgggattacaggtatgtgccaccatgcccggctaatttttgtatttttttttttttagtagagatggggttttaccatgttgaccaggttggttttgaactcctgacctcaggtgatacccctgacttggccttccaaagtgctgggattaaaggtgtgagccactgcacccagccggatcaggcacttttaacttgaaaacatgaagttctctttcctaacttttttctttctttcttttttttttttttttccgagacaggatctcactctgtcacccaggctggagtgcagggatgccatcacagctcactgcagccctgacctcctgggctcaagcaatcctcccagctcatcctcccaaatggctgggactataggcttagaccaccatacccaactaatttttgtatttttgtgtgaagatgaggtctccctatgtttcccaggctggtcttgatctcctgggctcaagcaatccatcagccttggcctcccaaagcactgggattataggcatgagccaccaaggacggccccctaatgttttttatattggctaatgagctttaagtttatacatacaaggcataaagaaataactttaaagttatgttattagatgtacagtgatatgatttagctctgtgtccccacccaagtctcatcttgtagctcccataactcccatgtgttgtgaaagggacctggtgggagatgattgaatcgtggaggtgggtctttcccgtgctgttctcatgataatgaatgggtctcacaagatctgatggttttaaaaacgggagtttctctgcacaagctctctctttgcctggtgccatccacataagatgtgacttgcttctccttgccttccaccatgattgtaaggtctccccagccatgtggaactgtaaatccaataaacctctttcgtaaattgcccagtcttgcatatgtctttatcagcagcgtgaaaacagatgaatacagtaaatttgtactgggagtggggcattgctgaaaagatacccaaaaatgtggaagcgactttggaactggggaacaggcagaggttggaacagtttggagcgctcagatgaagacaggaaaatgtgggaaagtctggagcttcctagagacttgttgaagggccttgaccaaaagcctgatagtgatatggacaataaggtccaggctgaggtggtctcagatgaagatgaggaacttgttgggaactggagcaaaggtaactcttgtatgttttagcaaagagactggcagcattttgtccctgccctagagatttgcagaactttgaactcgagagagatggtttaggctatctggtggaagaaatttgtttattattattattattattattattattattattattttgagatagagtctcactctgtcacccaggccagaggacagtagcgtgaccttggctcactgcaaccttcgcctcctgagttcaagcgtttctcatgtctcggcctcccaagcagctgagataacaggcatgtgcctccatgcctggctaatttttgtattttagaagagacagggattcaccacattggccaggctggtctcaaactcctgacctcaaatgatccaactcagcctcctgaagtgttggaattacaggcatgagccaccacacctggctgcggaagaaatttctaagctgcaaagcattcaagaggtgacttgggtgtggttaaaggaattcagttttataagggaagcagagaataaaggttcagaaaatttgcagcctgacaatgcgatagaaaagaaaagccaattttctgaggagaaattcaagccagctgcagaaatgtgcataagtaacaagaggaacattaacccccaatacaatggggaaaatgtctccagggcatgtcagaggtcttcttggcagcccctcccatcacaggcccagaggcctaggagaaatggttccgtgggccaggtccagggtccccgtgctgtatgtagcctagggacttggtgccttgtgtcccagctgctccagccatggctgaaaggggccaacatagagcttaggccatggctgcagagggtgaaagccccagtccttggcagcttccacgtggtattgagcttgcaagtgcacagaagtcaagaattggggtttgggaacctccacctagatttcagaagatgtatggaaatgcctggatgcccaggcagaagtttgctgcaggggtggggtgctcatggagaacctctgctagggcagggcggaagggaaatgtggggttggagctcccacacagagtccttactggggcactgcctagggcagctgtgagaagagggccattgtcctctagccccaagaatggtagatccactgacagcttgcactgtttgcctggaaaagctgcagacactcaatgccagcctgtgaaagcagccgggagggaggctgtacactgaaaagccacaggggcggagctgccagagaccatgggaacccacctcttacattagtgtgacctgatatgagagatggagtcaaaggagatcattttggagctttaagatttgactgccctgctggattttggacttgcaggggcctgtagcccctctgttttggctaatttctcccattttggagtggctgtatttacccaatacctgtactcccattgtatccaggaagtaactaacttgcttttgattttacaggctgataggcagaagtgtcttgctttttctttgctgagactttggactgtggacttttgagttaattctgaaatgagttgagactttgggggactgttgggaaggcatgattggttttgaaatgtgaagatatgagatttgggaggggacagggatggaatgatatggcttggctgtgtccccacccaaatctcatcttgtagctcccataattcactcatgttgtgggagggacctggtgggagatgattgaatcatgggggtgggtctttcccatgttcttgtgagagtgaatgggtctcacgagatctgatggtttttaaaacaggagtttctctgcacaagctctctctttgcctgctgtcatccacataagatgtgacttgctcctccttgccttctgccattattgtgaggtctccccagccatgtggaactgtaagtccaatgaacctctttcttttgtaaattgctctatctcgggtatgtctttatcattcctgaaaatggactaatacatacggcaatactcaagagagcaagtgtggatagcttgggttcatgaggtttttggtttttgtcaaaagcataaatgtatactgaaactacccagaaaaagcaaagtataaaacagtatgctaccatttgtgcccataaatgggatatgtgtagtgtaaatgcatagaatttgaccagatgtatacccagagaccagaacactcagtggcctcatgttcatactttggcaaacacatgtatagtatccttaacttaaatgtaccattgttgtgtgcattctagtgttattgacatttacatatctattatcaagtcagataaatcattctgtgtctttgtattttcacttcctattttgtatatttatgtatacatacacacataccaatacatatttaaataaggtataacttcacctggtccaaaaatcaaaacaacgtagaaaggtttacagtgaaaggtcgcatccctgatgctgtcctcttcccccaggtgatcaccttattggtttcttttcatacctttcagcattttctcctgcaagcacagatattctaactcctccttttttacacagaatttttttttacatagcattcttctgcaccttccttctcccacttcacaatgcacatggagatttttccgtatttgtacatcaggagcttcctctttctttgttaccacattaaattccactgggtagatgtaccataatttaactgggtccttattgaaagacaattgagctgtctcctagacaaagccttgtgcaccttcccgaacagagggtctaaccaagcaggcaggatggggttataaagtaggtggggaggtgggagagactccaccctcccaggtgggctgaggatggaggtaaggccctgcaacaggacagagggaaaagtggggatgagacatgggaggcgagatagcgctcactgttctcgctcagccccctcctccatttgccgctgacctgttggcctcccccaacctctgagcctgcctctgcctaggtaatttcccaagacccaggaggggtgaagggtgaggtgcgattgcccccacctccttgcctcccgcagcatctgctccaggaccatgaacaatagctgacagctccatggcccttgctgtccccatctcagcttccctgggcatctaaacctcagttgccrtggggtaggaggacaggctgaggaagcagaagcctgaggctgtctagagtctcactcctgcatcagcaggccaccacctgtggttcctccttgtgcaaatttgagaggaattgcataaaacactggagaaatccaagaggggaagtcc

SEQ ID NO: 5 - DNA, 300 bp, Homo sapiens
agttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggrtaacacttgcttttccagttaatgtggccatgtgattccaagtgtcatgttgctttgtggcaagattgttgtgtgacttgtttttttgtttttgtttttgtttttttaaaggaaactatttgtggg

SEQ ID NO: 6 - DNA, 2986 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggcccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagggtcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 7 - DNA, 1243 bp, Homo sapiens
ctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagc

SEQ ID NO: 8 - DNA, 3000 bp, Homo sapiens
ccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgatctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctgggacccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcacgcaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctcaacggagcgggcggcggcgctggcggggcggcaggcgcggagggcggacccgaggcggcggggggcgcggccgagtcgccggcggagggcgaggtcttcgccatacagctgacatcggcgtgagccgctcccctctccccgcgggccgggggacgccccccagactcacacgggggcttatttattgctttatttatttacttattcatttatttatgtattcaactccaagggcgtcacccccattttctacccatcccctcaataaagtttttataaagga

SEQ ID NO: 9 - DNA, 2372 bp, Homo sapiens
gagaaatggcgtggcaggggacccagcgagcccagagggattttgccgctgcttcctctacccctgtatttcacgcagctctctaaattgactcagctccaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactgtcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatatggggggagtgagctctctcagacccttgaagatgtagcttccaaatttgaatggattaaatggcacctgtatacca

SEQ ID NO: 10 - DNA, 3920 bp, Homo sapiens
ttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtatgccagcgccaactggatcacaatctccctctttttaagtatctcaaaggaccaagccagagacttataaaataccagatgctgttgaagggtctgctggatttcgagtctcctgaagatatggagatagacccaggtgaactaggaggctcggctaaggatgggccaaagagaaccaaagattcagcattctcaactgaactacaacaagctttggcagtgatagaggatttgatcaagtcctgtgagttggctgtggacctagcagcagtgactgaatgtccggacgatattggaaaactaggcaagctgttgctgcacggccctttcagcgtctggacaattcacaaggatcgttataaaatgaaggatttgattcgatttaaacccagccagaggcaaatctacctatttgaaaggggaatagtgttctgtaagatacgaatggagcctggggaccagggattatctcctcattacagcttcaagaagaccatgaagctgatgacactttcaattcgccagcttggaagggggagccatagaaagtttgagattgccagtcgaaatggacttgagaaatacatcctgcaggcagcttcaaaagaaatcagagactgttggttttcagaaataagtaaattattgatggaacaacaaaataatatcaaagaccaaggaaatccacagtttgaaatgagcacgagcaaaggcagtggagcaggatccggaccatggattaaaaatatggaaagagctaccactagcaaggaagacccggcctccagcacaggagggattaaaggctgctccagcagggagtttagctccatggacacctttgaagactgtgaaggcgcagaagacatggaaaaggagagcagtgctctgagtctcgcgggccttttccagtcggacgacagtcacgaaacctgttcctccaaatctgctttcctggagaggggagaaagcagccagggagaaaaagaagaacgcgatgaggaggaaacggcgacccgcagcaccgaggaggagcgcgctggggcgtccacgggccggctggctcctgcgggggcgacggctggtttccaggcgagggcgctgcgcccgaggacctccgcccaggagagctgacctccctgcggacgcccccgctcctcggctccagagcgcccgcattcccgggagaggcggtgtgggggcccgggccctgcccagctacgcagaaagcagccggagcctcggcggcggcagaaaggggacaaccagggcctcctccgaggagcccgaggggtgtcctgggtgcgcgcctagctccgcacgggggacctcggagctgctctaaggcgcctgcagaggcgagcagagcccgcagcccacgccttctcgaccgcgcacttcgacattcggagccgggcaattctttgctgcgtgggcttctctgtgctcccacggtaggatgtttagtagcacccctggcctctacccactaggtgccaggaatgcgccaccccatcctccaccccgcccccaaatcgtgacaatcaaaaatgcctgcagacacgcccgcatttctccagggcggggtgggaatcggttgagagccgcttagcccgagc

SEQ ID NO: 11 - DNA, 852 bp, Homo sapiens
cttggaggagccggagccgctcaaacccggcgggggccgcagactgggagctcccggtccgcctcccagcatccctgcgagcgttcatggggtgttcgtgttagtgccaagattgcttcgttgtagagagagttcgttccaagttactttctgaggtattttatgtatcgatttattagtttttaaatgagttttgttagtttcagttgtattttatttttagttttattagttgattttcatttctttgtagctttctggttatttaattttatagtttcagttactggtttatagttactttattttcaaagttatttagttgttcattttcagttatttatatgtagttgttttgttttaggagttacagatgttcaaattaatttgcttggaatttatttatttatttatttatttatttttcgagacggagtctcgctctgtcgcccaggctggagtgcagtggtgtgatctcggctcactgcaaaccgcctcccgggttcacgccattctcctgcctcagcctcctgagtagctgggactacaggcgcccgccaccacgcccggctaattttttatttggatttttagtagagacggggtttccccgtgttagccaggatggtctcgatctcctgacctcgtgatccccctgcctcggcctcccaaagtgctgggattacaggcgtgagccaccgcgcccagccggaatttatttttaattatctttacaattattatctgagttatttaccttcatagttatttcactttatcttattggagtttttgagttatttatttttacagtaacttatttgactattaaacactcactggaagttcatg

SEQ ID NO: 12 - DNA, 7217 bp, Homo sapiens
gcccacgaagaggtacgattccggagaatcgcgaggcagagcgggagcgcgcagccaggtggaaactaattctaagccagactgctggagatcaccctgttctagtgtgtggaggcttccaccaggagtctggagtgcaatggcacgatctcggctcactgcaacctccacctcccaggttcaagcgattctcctgcctcagcctcccaagtagctgggattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattactgcagcttggggaggcccatcaggctgagactgaagtcctgcggcgggagctggcagaggccatggctgcccagcacacagctgagagtgagtgtgagcagctcgtcaaagaagtagctgcctggcgtgacgggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacaaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaagcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagagctgcgcctgctgcaggcagagacagccagcaacagtgccagagctgcagaacgcagctctgctctgcgggaggaggtgcagagcctccgggagggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggaaaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcttccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagtgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggcccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctattttt

SEQ ID NO: 13 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTREVTVNVLSPRYEIVIITVVAAAVIMGTAGLSTYLYNRQRKIKKYRLQQAQKGTPMKPNTQATPP

SEQ ID NO: 14 - protein, 271 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTALASGSIAALVGILLTVGAAYLCKCLAMKSQA

SEQ ID NO: 15 - protein, 924 aa, Homo sapiens
MPGPSPGLRRALLGLWAALGLGLFGLSAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLICNVTLGGENRETRENVTIYSFPAPLLTLSEPSVSEGQMVTVTCAAGTQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECARTNAHGRHARRITVRVAGPWLWVAVGGAAGGAALLAAGAGLAFYVQSTACKKGEYNVQEAESSGEAVCLNGAGGGAGGAAGAEGGPEAAGGAAESPAEGEVFAIQLTSA

SEQ ID NO: 16 - protein, 422 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 17 - protein, 1114 aa, Homo sapiens
MLSCLKEEMPPQELTRRLATVITHVDEIMQQEVRPLMAVEIIEQLHRQFAILSGGRGEDGAPIITFPEFSGFKHIPDEDFLNVMTYLTSIPSVEAASIGFIVVIDRRRDKWSSVKASLTRIAVAFPGNLQLIFILRPSRFIQRTFTDIGIKYYRNEFKTKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTETELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVCQRQLDHNLPLFKYLKGPSQRLIKYQMLLKGLLDFESPEDMEIDPGELGGSAKDGPKRTKDSAFSTELQQALAVIEDLIKSCELAVDLAAVTECPDDIGKLGKLLLHGPFSVWTIHKDRYKMKDLIRFKPSQRQIYLFERGIVFCKIRMEPGDQGLSPHYSFKKTMKLMTLSIRQLGRGSHRKFEIASRNGLEKYILQAASKEIRDCWFSEISKLLMEQQNNIKDQGNPQFEMSTSKGSGAGSGPWIKNMERATTSKEDPASSTGGIKGCSSREFSSMDTFEDCEGAEDMEKESSALSLAGLFQSDDSHETCSSKSAFLERGESSQGEKEERDEEETATRSTEEERAGASTGRLAPAGATAGFQARALRPRTSAQES

SEQ ID NO: 18 - protein, 2101 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLLQLGEAHQAETEVLRRELAEAMAAQHTAESECEQLVKEVAAWRDGYEDSQQEEAQYGAMFQEQLMTLKEECEKARQELQEAKEKVAGIESHSELQISRQQNKLAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEESCACCRQRQPATVPELQNAALLCGRRCRASGREAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRFQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 19 - DNA, 21 bp, Artificial Sequence
  Primer
gacagccacagctagcgcaga

SEQ ID NO: 20 - DNA, 22 bp, Artificial Sequence
  Primer
tgttttcgccccccagggtgac

SEQ ID NO: 21 - DNA, 21 bp, Artificial Sequence
  Primer
ctgattattctgatggtaatg

SEQ ID NO: 22 - DNA, 21 bp, Artificial Sequence
  Primer
gcccatgttaacattttcttc

SEQ ID NO: 23 - DNA, 20 bp, Artificial Sequence
  Primer
atgtcaagtgcacccacatg

SEQ ID NO: 24 - DNA, 20 bp, Artificial Sequence
  Primer
aggaagaaactgacggaagg

SEQ ID NO: 25 - DNA, 20 bp, Artificial Sequence
  Primer
taatacaaaggtggcagcag

SEQ ID NO: 26 - DNA, 20 bp, Artificial Sequence
  Primer
ttgacaaggataaggacaag

SEQ ID NO: 27 - DNA, 21 bp, Artificial Sequence
  Primer
gcacatggccacattaactgg

SEQ ID NO: 28 - DNA, 22 bp, Artificial Sequence
  Primer
tggctgtggaaattgggtcttg

SEQ ID NO: 29 - DNA, 19 bp, Artificial Sequence
  Primer
cccagggtgacgttgcaga

SEQ ID NO: 30 - DNA, 24 bp, Artificial Sequence
  Primer
attattctgatggtaatgatccag

SEQ ID NO: 31 - DNA, 19 bp, Artificial Sequence
  Primer
cacatgcctgctcgccccc

SEQ ID NO: 32 - DNA, 18 bp, Artificial Sequence
  Primer
aaggggaggtcgactggg

SEQ ID NO: 33 - DNA, 18 bp, Artificial Sequence
  Primer
ggcatctggcagtcatgg

SEQ ID NO: 34 - DNA, 30 bp, Artificial Sequence
  Primer
acgttggatgctcacagagcacattcacgg

SEQ ID NO: 35 - DNA, 30 bp, Artificial Sequence
  Primer
acgttggatgagatcttgagggcacctacc

SEQ ID NO: 36 - DNA, 30 bp, Artificial Sequence
  Primer
acgttggatgaggtgacaccttcctcgaag

SEQ ID NO: 37 - DNA, 30 bp, Artificial Sequence
  Primer
acgttggatgtgtgaagcacctcttctgag

SEQ ID NO: 38 - DNA, 30 bp, Artificial Sequence
  Primer
acgttggatggtccaggtgacaccttcctc

SEQ ID NO: 39 - DNA, 30 bp, Artificial Sequence
  Primer
acgttggatgaagcacctcttctgagccag

SEQ ID NO: 40 - DNA, 30 bp, Artificial Sequence; identical to SEQ ID NO: 38
  Primer

SEQ ID NO: 41 - DNA, 30 bp, Artificial Sequence; identical to SEQ ID NO: 39
  Primer

SEQ ID NO: 42 - DNA, 30 bp, Artificial Sequence
  Primer
acgttggatgttcaacaagcgagtgacagc

SEQ ID NO: 43 - DNA, 30 bp, Artificial Sequence
  Primer
acgttggatggtgcagagatgggctttctc

SEQ ID NO: 44 - DNA, 30 bp, Artificial Sequence
  Primer
acgttggatgtgtagatggtcacgttctcc

SEQ ID NO: 45 - DNA, 29 bp, Artificial Sequence
  Primer
cgttggatgatctgagtcctgatgtcacc

SEQ ID NO: 46 - DNA, 30 bp, Artificial Sequence
  Primer
acgttggatgttgcagctttaagctaaggc

SEQ ID NO: 47 - DNA, 30 bp, Artificial Sequence
  Primer
acgttggatgagcccaggagacttaattac

SEQ ID NO: 48 - DNA, 31 bp, Artificial Sequence
  Primer
acgttggatgtacagacccctctaccccttc

SEQ ID NO: 49 - DNA, 30 bp, Artificial Sequence; identical to SEQ ID NO: 36
  Primer

SEQ ID NO: 50 - DNA, 30 bp, Artificial Sequence
  Primer
acgttggatgtgacctcaggtgattcaccc

SEQ ID NO: 51 - DNA, 30 bp, Artificial Sequence
  Primer
acgttggatgggtatacctttagctggctg

SEQ ID NO: 52 - DNA, 30 bp, Artificial Sequence
  Primer
acgttggatgtcaaagctcacagttctcgg

SEQ ID NO: 53 - DNA, 30 bp, Artificial Sequence
  Primer
acgttggatgacttagcgggtcctgcaaac

SEQ ID NO: 54 - DNA, 30 bp, Artificial Sequence
  Primer
acgttggatgaaggcaccttcctctgtcag

SEQ ID NO: 55 - DNA, 31 bp, Artificial Sequence
  Primer
acgttggatgtgggccacaacacggatggta

SEQ ID NO: 56 - DNA, 30 bp, Artificial Sequence
  Primer
acgttggatggcacaaagagctaaggtagg

SEQ ID NO: 57 - DNA, 30 bp, Artificial Sequence
  Primer
acgttggatggaatcctggatagacagtgg

SEQ ID NO: 58 - DNA, 30 bp, Artificial Sequence
  Primer
acgttggatgtaacgtagagcacaggtgag

SEQ ID NO: 59 - DNA, 30 bp, Artificial Sequence
  Primer
acgttggatgcaacgcaaacaccagtgtgg

SEQ ID NO: 60 - DNA, 30 bp, Artificial Sequence
  Primer
acgttggatgaagagacagtggagaggctg

SEQ ID NO: 61 - DNA, 31 bp, Artificial Sequence
  Primer
acgttggatgagagccatcgggtcccagcaa

SEQ ID NO: 62 - DNA, 30 bp, Artificial Sequence
  Primer
acgttggatgtgcgctcagtcagcttcctc

SEQ ID NO: 63 - DNA, 30 bp, Artificial Sequence
  Primer
acgttggatgagtgttagccgagggcaagc

SEQ ID NO: 64 - DNA, 30 bp, Artificial Sequence
  Primer
acgttggatgccaggactgtctctctgttt

SEQ ID NO: 65 - DNA, 30 bp, Artificial Sequence
  Primer
acgttggatgatgacactacagcctgagca

SEQ ID NO: 66 - DNA, 30 bp, Artificial Sequence
  Primer
acgttggatgagtgttgctttgtcacccag

SEQ ID NO: 67 - DNA, 30 bp, Artificial Sequence
  Primer
acgttggatgaggagaatcgcttgtacctg

SEQ ID NO: 68 - DNA, 30 bp, Artificial Sequence
  Primer
acgttggatgagaaatcctcctaccttggc

SEQ ID NO: 69 - DNA, 30 bp, Artificial Sequence
  Primer
acgttggatggcccggcctctacataaaat

SEQ ID NO: 70 - DNA, 30 bp, Artificial Sequence
  Primer
acgttggatgaacctcaagctgcttcactg

SEQ ID NO: 71 - DNA, 30 bp, Artificial Sequence
  Primer
acgttggatggaggagcccacctttaatgt

SEQ ID NO: 72 - DNA, 30 bp, Artificial Sequence
  Primer
acgttggatgacctgtgtttctaggtgtgc

SEQ ID NO: 73 - DNA, 30 bp, Artificial Sequence
  Primer
acgttggatgcatgcctgggaaaaaactcc

SEQ ID NO: 74 - DNA, 30 bp, Artificial Sequence
  Primer
acgttggatgatcctcacacctcagtctcc

SEQ ID NO: 75 - DNA, 30 bp, Artificial Sequence
  Primer
acgttggatgaatgagactccgtctctacc

SEQ ID NO: 76 - DNA, 30 bp, Artificial Sequence
  Primer
acgttggatggacaattgtagtacccagcc

SEQ ID NO: 77 - DNA, 30 bp, Artificial Sequence
  Primer
acgttggatgaggagaatcgcttgaacctg

SEQ ID NO: 78 - DNA, 30 bp, Artificial Sequence
  Primer
acgttggatgagtagctggaattacaggcg

SEQ ID NO: 79 - DNA, 30 bp, Artificial Sequence
  Primer
acgttggatggccaacatgatgaaatcccg

SEQ ID NO: 80 - DNA, 30 bp, Artificial Sequence
  Primer
acgttggatgactgggattacaggtgtgag

SEQ ID NO: 81 - DNA, 30 bp, Artificial Sequence
  Primer
acgttggatgggagaaatcttgatggaggc

SEQ ID NO: 82 - DNA, 30 bp, Artificial Sequence
  Primer
acgttggatgagctgggactttccttcttg

SEQ ID NO: 83 - DNA, 30 bp, Artificial Sequence
  Primer
acgttggatgcagtaaatccagccttcagc

SEQ ID NO: 84 - DNA, 30 bp, Artificial Sequence
  Primer
acgttggatgccacgcctggctaatttttg

SEQ ID NO: 85 - DNA, 30 bp, Artificial Sequence
  Primer
acgttggatgggtcaggagttcaagaccag

SEQ ID NO: 86 - DNA, 30 bp, Artificial Sequence
  Primer
acgttggatgcatggttcactgcagtcttg

SEQ ID NO: 87 - DNA, 30 bp, Artificial Sequence
  Primer
acgttggatgtgtggtgttgtgagcctatg

SEQ ID NO: 88 - DNA, 30 bp, Artificial Sequence
  Primer
acgttggatgataggctcacaacaccacac

SEQ ID NO: 89 - DNA, 30 bp, Artificial Sequence
  Primer
acgttggatgaacacaaaggaagtctgggc

SEQ ID NO: 90 - DNA, 30 bp, Artificial Sequence; identical to SEQ ID NO: 88
  Primer

SEQ ID NO: 91 - DNA, 30 bp, Artificial Sequence; identical to SEQ ID NO: 89
  Primer

SEQ ID NO: 92 - DNA, 31 bp, Artificial Sequence
  Primer
acgttggatgacctgaggtttcctcactcag

SEQ ID NO: 93 - DNA, 30 bp, Artificial Sequence
  Primer
acgttggatgagaggtttctgtgacacccg

SEQ ID NO: 94 - DNA, 30 bp, Artificial Sequence
  Primer
acgttggatggcggagccatacctctaagc

SEQ ID NO: 95 - DNA, 29 bp, Artificial Sequence
  Primer
acgttggatgtcgctggcactttcgtccc

SEQ ID NO: 96 - DNA, 30 bp, Artificial Sequence
  Primer
acgttggatgctggctgagatgccatgata

SEQ ID NO: 97 - DNA, 30 bp, Artificial Sequence
  Primer
acgttggatgatggtgggaggagctaaatg

SEQ ID NO: 98 - DNA, 30 bp, Artificial Sequence
  Primer
acgttggatggccatgataataagctggac

SEQ ID NO: 99 - DNA, 30 bp, Artificial Sequence
  Primer
acgttggatgtcttagtccccaaatgtatc

SEQ ID NO: 100 - DNA, 30 bp, Artificial Sequence
  Primer
acgttggatgggtgggaaaaagacgtgaag

SEQ ID NO: 101 - DNA, 30 bp, Artificial Sequence
  Primer
acgttggatgagagggaattaaggaggtcc

SEQ ID NO: 102 - DNA, 30 bp, Artificial Sequence
  Primer
acgttggatgaattccgtgggatgaggaat

SEQ ID NO: 103 - DNA, 31 bp, Artificial Sequence
  Primer
acgttggatgaccgtgttttccaggctcgcg

SEQ ID NO: 104 - DNA, 31 bp, Artificial Sequence
  Primer
acgttggatgacttggccccctgcactcaca

SEQ ID NO: 105 - DNA, 31 bp, Artificial Sequence; identical to SEQ ID NO: 103
  Primer

SEQ ID NO: 106 - DNA, 30 bp, Artificial Sequence
  Primer
acgttggatggttgggattacaggcatgag

SEQ ID NO: 107 - DNA, 30 bp, Artificial Sequence
  Primer
acgttggatgatctgttgcctgtcaagatg

SEQ ID NO: 108 - DNA, 30 bp, Artificial Sequence; identical to SEQ ID NO: 98
  Primer

SEQ ID NO: 109 - DNA, 30 bp, Artificial Sequence
  Primer
acgttggatgaaatgtatccccgccctaag

SEQ ID NO: 110 - DNA, 29 bp, Artificial Sequence
  Primer
acgttggatgtactcaggaggctgaggtg

SEQ ID NO: 111 - DNA, 30 bp, Artificial Sequence; identical to SEQ ID NO: 86
  Primer

SEQ ID NO: 112 - DNA, 30 bp, Artificial Sequence; identical to SEQ ID NO: 94
  Primer

SEQ ID NO: 113 - DNA, 29 bp, Artificial Sequence
  Primer
acgttggatgtcgctggcactttcgtccc

SEQ ID NO: 114 - DNA, 30 bp, Artificial Sequence; identical to SEQ ID NO: 96
  Primer

SEQ ID NO: 115 - DNA, 30 bp, Artificial Sequence; identical to SEQ ID NO: 97
  Primer

SEQ ID NO: 116 - DNA, 30 bp, Artificial Sequence
  Primer
acgttggatgtgagagaaggcgatcttgac

SEQ ID NO: 117 - DNA, 30 bp, Artificial Sequence
  Primer
acgttggatgccaattcacaatccactgtg

SEQ ID NO: 118 - DNA, 30 bp, Artificial Sequence; identical to SEQ ID NO: 116
  Primer

SEQ ID NO: 119 - DNA, 30 bp, Artificial Sequence; identical to SEQ ID NO: 117
  Primer

SEQ ID NO: 120 - DNA, 30 bp, Artificial Sequence
  Primer
acgttggatggtttgtttttagagacaggg

SEQ ID NO: 121 - DNA, 30 bp, Artificial Sequence
  Primer
acgttggatggtcaaagccacttccagcta

SEQ ID NO: 122 - DNA, 30 bp, Artificial Sequence
  Primer
acgttggatgcgatctggtcgctctgcaag

SEQ ID NO: 123 - DNA, 30 bp, Artificial Sequence
  Primer
acgttggatggccccaccttctgttccaag

SEQ ID NO: 124 - DNA, 30 bp, Artificial Sequence
  Primer
acgttggatgtctgggcaatgttgcaagac

SEQ ID NO: 125 - DNA, 30 bp, Artificial Sequence; identical to SEQ ID NO: 88
  Primer

SEQ ID NO: 126 - DNA, 30 bp, Artificial Sequence; identical to SEQ ID NO: 124
  Primer

SEQ ID NO: 127 - DNA, 30 bp, Artificial Sequence; identical to SEQ ID NO: 88
  Primer

SEQ ID NO: 128 - DNA, 30 bp, Artificial Sequence; identical to SEQ ID NO: 43
  Primer

SEQ ID NO: 129 - DNA, 30 bp, Artificial Sequence
  Primer
acgttggatgagatgggcacaatgtccgac

SEQ ID NO: 130 - DNA, 30 bp, Artificial Sequence
  Primer
acgttggatgactgccacagccacagctag

SEQ ID NO: 131 - DNA, 29 bp, Artificial Sequence
  Primer
acgttggatgttttcgccccccagggtga

SEQ ID NO: 132 - DNA, 30 bp, Artificial Sequence
  Primer
acgttggatggtacaactgtacctggtgac

SEQ ID NO: 133 - DNA, 30 bp, Artificial Sequence
  Primer
acgttggatgaatgaacataggtctctggc

SEQ ID NO: 134 - DNA, 30 bp, Artificial Sequence
  Primer
acgttggatgtcccttccatcctcattttt

SEQ ID NO: 135 - DNA, 30 bp, Artificial Sequence
  Primer
acgttggatgtgcaaggcgctaaacaaaac

SEQ ID NO: 136 - DNA, 30 bp, Artificial Sequence
  Primer
acgttggatgtcggcctggctcagaagagg

SEQ ID NO: 137 - DNA, 31 bp, Artificial Sequence
  Primer
acgttggatgacccctaccccacgctaccca

SEQ ID NO: 138 - DNA, 30 bp, Artificial Sequence
  Primer
acgttggatgggaatggatgcagaagcccg

SEQ ID NO: 139 - DNA, 29 bp, Artificial Sequence
  Primer
acgttggatgaagctgaggccacagggag

SEQ ID NO: 140 - DNA, 30 bp, Artificial Sequence
  Primer
acgttggatgaatggatgcagaagcccgtc

SEQ ID NO: 141 - DNA, 30 bp, Artificial Sequence
  Primer
acgttggatgattccacggaggaagctgag

SEQ ID NO: 142 - DNA, 30 bp, Artificial Sequence
  Primer
acgttggatgatcagctctacgcgatctgg

SEQ ID NO: 143 - DNA, 31 bp, Artificial Sequence
  Primer
acgttggatgttcaggccccaccttctgttc

SEQ ID NO: 144 - DNA, 31 bp, Artificial Sequence
  Primer
acgttggatgtcaacctctggtcccccagtg

SEQ ID NO: 145 - DNA, 29 bp, Artificial Sequence
  Primer
acgttggatgaggggaccgtggtctgttc

SEQ ID NO: 146 - DNA, 30 bp, Artificial Sequence
  Primer
acgttggatgttgccataggtgactgtggg

SEQ ID NO: 147 - DNA, 30 bp, Artificial Sequence
  Primer
acgttggatgtcctagaggtggacacgcag

SEQ ID NO: 148 - DNA, 30 bp, Artificial Sequence
  Primer
acgttggatgaagatgccagtccgtggacc

SEQ ID NO: 149 - DNA, 30 bp, Artificial Sequence
  Primer
acgttggatgctggagacccagtgtctctc

SEQ ID NO: 150 - DNA, 30 bp, Artificial Sequence
  Primer
acgttggatggggcagatggtgacagtaac

SEQ ID NO: 151 - DNA, 30 bp, Artificial Sequence
  Primer
acgttggatgtggaactccctccagtgtga

SEQ ID NO: 152 - DNA, 30 bp, Artificial Sequence; identical to SEQ ID NO: 150
  Primer

SEQ ID NO: 153 - DNA, 30 bp, Artificial Sequence; identical to SEQ ID NO: 151
  Primer

SEQ ID NO: 154 - DNA, 30 bp, Artificial Sequence
  Primer
acgttggatgagcggcagttaccatgttag

SEQ ID NO: 155 - DNA, 30 bp, Artificial Sequence
  Primer
acgttggatgttcttcccccattgcttctg

SEQ ID NO: 156 - DNA, 30 bp, Artificial Sequence; identical to SEQ ID NO: 154
  Primer

SEQ ID NO: 157 - DNA, 30 bp, Artificial Sequence; identical to SEQ ID NO: 155
  Primer

SEQ ID NO: 158 - DNA, 30 bp, Artificial Sequence
  Primer
acgttggatgggtgatggacattgagggtg

SEQ ID NO: 159 - DNA, 29 bp, Artificial Sequence
  Primer
acgttggatgtcccttctgtctccaaccc

SEQ ID NO: 160 - DNA, 30 bp, Artificial Sequence
  Primer
acgttggatgtcgtggtgatggacattgag

SEQ ID NO: 161 - DNA, 30 bp, Artificial Sequence
  Primer
acgttggatgaagtcaatatgcgtcccttc

SEQ ID NO: 162 - DNA, 30 bp, Artificial Sequence
  Primer
acgttggatgaagaggctatgtggcagatg

SEQ ID NO: 163 - DNA, 30 bp, Artificial Sequence
  Primer
acgttggatgagggtgaagctgggtttaac

SEQ ID NO: 164 - DNA, 30 bp, Artificial Sequence
  Primer
acgttggatgtgggccagaacttcaccctg

SEQ ID NO: 165 - DNA, 29 bp, Artificial Sequence
  Primer
acgttggatgaagcagcaccaccgtgagg

SEQ ID NO: 166 - DNA, 30 bp, Artificial Sequence
  Primer
acgttggatgaatctcagcaacgtgactgg

SEQ ID NO: 167 - DNA, 30 bp, Artificial Sequence
  Primer
acgttggatgacacggtgatgttagaggag

SEQ ID NO: 168 - DNA, 30 bp, Artificial Sequence; identical to SEQ ID NO: 166
  Primer

SEQ ID NO: 169 - DNA, 30 bp, Artificial Sequence; identical to SEQ ID NO: 167
  Primer

SEQ ID NO: 170 - DNA, 30 bp, Artificial Sequence
  Primer
acgttggatgtaaggcaggaggatggagtg

SEQ ID NO: 171 - DNA, 30 bp, Artificial Sequence
  Primer
acgttggatggacagagtctcactctgtcg

SEQ ID NO: 172 - DNA, 30 bp, Artificial Sequence
  Primer
acgttggatgaagacgtgaagagacacacc

SEQ ID NO: 173 - DNA, 30 bp, Artificial Sequence; identical to SEQ ID NO: 101
  Primer

SEQ ID NO: 174 - DNA, 30 bp, Artificial Sequence
  Primer
acgttggatgcttgttctcgcgtggatgtc

SEQ ID NO: 175 - DNA, 30 bp, Artificial Sequence
  Primer
acgttggatgtactcagcgtgtgtgagctc

SEQ ID NO: 176 - DNA, 30 bp, Artificial Sequence
  Primer
acgttggatgaccctccagaccttgaacca

SEQ ID NO: 177 - DNA, 30 bp, Artificial Sequence
  Primer
acgttggatgacgtaacgctaacggtggag

SEQ ID NO: 178 - DNA, 30 bp, Artificial Sequence
  Primer
acgttggatgataccctactcctactcttc

SEQ ID NO: 179 - DNA, 30 bp, Artificial Sequence
  Primer
acgttggatgtcaaggacgtaacgctaacg

SEQ ID NO: 180 - DNA, 30 bp, Artificial Sequence
  Primer
acgttggatgtcaggaagctcccagacaga

SEQ ID NO: 181 - DNA, 30 bp, Artificial Sequence
  Primer
acgttggatgataacccttggacgccgatc

SEQ ID NO: 182 - DNA, 30 bp, Artificial Sequence
  Primer
acgttggatgttagacgaaaaaggcgccac

SEQ ID NO: 183 - DNA, 30 bp, Artificial Sequence
  Primer
acgttggatgttgtccctgcataacccttg

SEQ ID NO: 184 - DNA, 30 bp, Artificial Sequence
  Primer
acgttggatgtgagcgtggcaggcgccatg

SEQ ID NO: 185 - DNA, 29 bp, Artificial Sequence
  Primer
acgttggatggcgtggcgcccgtgcgcgt

SEQ ID NO: 186 - DNA, 30 bp, Artificial Sequence
  Primer
acgttggatgtgtggcaaatgatggaacag

SEQ ID NO: 187 - DNA, 30 bp, Artificial Sequence
  Primer
acgttggatgccagaagtttgagatctgcc

SEQ ID NO: 188 - DNA, 29 bp, Artificial Sequence
  Primer
acgttggatgggcgaggtatctgagaggg

SEQ ID NO: 189 - DNA, 30 bp, Artificial Sequence
  Primer
acgttggatgtactctgtcccacttccgtc

SEQ ID NO: 190 - DNA, 30 bp, Artificial Sequence
  Primer
acgttggatgggcagctctgattggatgtt

SEQ ID NO: 191 - DNA, 30 bp, Artificial Sequence
  Primer
acgttggatgctccacagttgtttggcctc

SEQ ID NO: 192 - DNA, 30 bp, Artificial Sequence
  Primer
acgttggatgagagacccagaaggtcatag

SEQ ID NO: 193 - DNA, 30 bp, Artificial Sequence
  Primer
acgttggatgcctcccccaagaaaacattg

SEQ ID NO: 194 - DNA, 30 bp, Artificial Sequence
  Primer
acgttggatgggccacttcttctgtaagtc

SEQ ID NO: 195 - DNA, 30 bp, Artificial Sequence
  Primer
acgttggatgcatgaggacatacaactggg

SEQ ID NO: 196 - DNA, 30 bp, Artificial Sequence
  Primer
acgttggatgaaagcctggaataggcacac

SEQ ID NO: 197 - DNA, 30 bp, Artificial Sequence
  Primer
acgttggatgtgcagacagtgaccatctac

SEQ ID NO: 198 - DNA, 30 bp, Artificial Sequence
  Primer
acgttggatgggagacatagcgagattctg

SEQ ID NO: 199 - DNA, 30 bp, Artificial Sequence
  Primer
acgttggatgtagaaagcagtgcgatctgg

SEQ ID NO: 200 - DNA, 30 bp, Artificial Sequence
  Primer
acgttggatgaaatcgtttgaacccgggag

SEQ ID NO: 201 - DNA, 30 bp, Artificial Sequence
  Primer
acgttggatggttttgagacagagtctcac

SEQ ID NO: 202 - DNA, 30 bp, Artificial Sequence
  Primer
acgttggatgtttcgggctgcaatggtccc

SEQ ID NO: 203 - DNA, 30 bp, Artificial Sequence
  Primer
acgttggatgtaacacctctctccttgtgc

SEQ ID NO: 204 - DNA, 30 bp, Artificial Sequence
  Primer
acgttggatgcggtctctgatggattctac

SEQ ID NO: 205 - DNA, 30 bp, Artificial Sequence
  Primer
acgttggatgaacaggccccaccatttaac

SEQ ID NO: 206 - DNA, 30 bp, Artificial Sequence
  Primer
acgttggatggagaggtgttaaatggtggg

SEQ ID NO: 207 - DNA, 30 bp, Artificial Sequence
  Primer
acgttggatgggaacatgaagaagtcctgg

SEQ ID NO: 208 - DNA, 30 bp, Artificial Sequence
  Primer
acgttggatgttcctgtttatggccagacg

SEQ ID NO: 209 - DNA, 30 bp, Artificial Sequence
  Primer
acgttggatggtctgaacctgattggagag

SEQ ID NO: 210 - DNA, 30 bp, Artificial Sequence
  Primer
acgttggatgatcttcagggatggtcactc

SEQ ID NO: 211 - DNA, 30 bp, Artificial Sequence
  Primer
acgttggatggacaaatacaaagggacagg

SEQ ID NO: 212 - DNA, 30 bp, Artificial Sequence
  Primer
acgttggatgacacacagcagggcatccgt

SEQ ID NO: 213 - DNA, 30 bp, Artificial Sequence
  Primer
acgttggatgcgcaatcaatgctttccacc

SEQ ID NO: 214 - DNA, 30 bp, Artificial Sequence
  Primer
acgttggatgtacatgaagaaggactcggc

SEQ ID NO: 215 - DNA, 30 bp, Artificial Sequence
  Primer
acgttggatgatccgtccagtgcacgtaga

SEQ ID NO: 216 - DNA, 30 bp, Artificial Sequence
  Primer
acgttggatgcaaagtgctaggatcacagg

SEQ ID NO: 217 - DNA, 30 bp, Artificial Sequence
  Primer
acgttggatgactgccccatagagtggcaa

SEQ ID NO: 218 - DNA, 30 bp, Artificial Sequence
  Primer
acgttggatgttttcgccccccagggtgac

SEQ ID NO: 219 - DNA, 30 bp, Artificial Sequence
  Primer
acgttggatgacagccacagctagcgcaga

SEQ ID NO: 220 - DNA, 22 bp, Artificial Sequence
  Primer
cagagcacattcacggtcacct

SEQ ID NO: 221 - DNA, 18 bp, Artificial Sequence
  Primer
aagggtgggcgtgggcct

SEQ ID NO: 222 - DNA, 18 bp, Artificial Sequence
  Primer
aagggtgggcgtgggcct

SEQ ID NO: 223 - DNA, 18 bp, Artificial Sequence
  Primer
aagggtgggcgtgggcct

SEQ ID NO: 224 - DNA, 19 bp, Artificial Sequence
  Primer
acaatgtccgactcccaca

SEQ ID NO: 225 - DNA, 18 bp, Artificial Sequence
  Primer
ccagggtgacgttgcaga

SEQ ID NO: 226 - DNA, 22 bp, Artificial Sequence
  Primer
taaggcaaagttcagctactta

SEQ ID NO: 227 - DNA, 18 bp, Artificial Sequence
  Primer
accccgtaccactgttga

SEQ ID NO: 228 - DNA, 18 bp, Artificial Sequence
  Primer
gctgggattataagcgtg

SEQ ID NO: 229 - DNA, 21 bp, Artificial Sequence
  Primer
gctcacagttctcggcaggac

SEQ ID NO: 230 - DNA, 20 bp, Artificial Sequence
  Primer
ccttcctctgtcagaatggc

SEQ ID NO: 231 - DNA, 20 bp, Artificial Sequence
  Primer
ggtgatttggggacagctga

SEQ ID NO: 232 - DNA, 18 bp, Artificial Sequence
  Primer
ggtccacaccgacgccag

SEQ ID NO: 233 - DNA, 19 bp, Artificial Sequence
  Primer
cccctgcccaggacacccc

SEQ ID NO: 234 - DNA, 18 bp, Artificial Sequence
  Primer
tcagcttcctccctcccc

SEQ ID NO: 235 - DNA, 22 bp, Artificial Sequence
  Primer
actgtctctctgtttttgagat

SEQ ID NO: 236 - DNA, 20 bp, Artificial Sequence
  Primer
gctttgtcacccaggctgga

SEQ ID NO: 237 - DNA, 20 bp, Artificial Sequence
  Primer
ctggggaactacaggaatgc

SEQ ID NO: 238 - DNA, 18 bp, Artificial Sequence
  Primer
gcccaccctccattcagc

SEQ ID NO: 239 - DNA, 20 bp, Artificial Sequence
  Primer
taggtgtgcgtgtgtgtgtg

SEQ ID NO: 240 - DNA, 18 bp, Artificial Sequence
  Primer
gagctgggaccacaggca

SEQ ID NO: 241 - DNA, 21 bp, Artificial Sequence
  Primer
ctttgtatacaatcttccctc

SEQ ID NO: 242 - DNA, 17 bp, Artificial Sequence
  Primer
gcgcccagcaccacgcc

SEQ ID NO: 243 - DNA, 18 bp, Artificial Sequence
  Primer
acaggtgtgagccactgc

SEQ ID NO: 244 - DNA, 18 bp, Artificial Sequence
  Primer
gggagtcatggagggttt

SEQ ID NO: 245 - DNA, 20 bp, Artificial Sequence
  Primer
tagagacggggtttcactat

SEQ ID NO: 246 - DNA, 20 bp, Artificial Sequence
  Primer
actgcagtcttgaccttttg

SEQ ID NO: 247 - DNA, 23 bp, Artificial Sequence
  Primer
ttttttttccagagacggggtct

SEQ ID NO: 248 - DNA, 20 bp, Artificial Sequence
  Primer
tttttccagagacggggtct

SEQ ID NO: 249 - DNA, 21 bp, Artificial Sequence
  Primer
cgaagccccagactctgtgta

SEQ ID NO: 250 - DNA, 19 bp, Artificial Sequence
  Primer
acccctccgggtcagctcc

SEQ ID NO: 251 - DNA, 20 bp, Artificial Sequence
  Primer
taataagctggactccgagc

SEQ ID NO: 252 - DNA, 20 bp, Artificial Sequence
  Primer
taataagctggactccgagc

SEQ ID NO: 253 - DNA, 20 bp, Artificial Sequence
  Primer
agacgtgaagagacacacct

SEQ ID NO: 254 - DNA, 18 bp, Artificial Sequence
  Primer
gcccgcgtcctcctctcc

SEQ ID NO: 255 - DNA, 18 bp, Artificial Sequence
  Primer
gcccgcgtcctcctctcc

SEQ ID NO: 256 - DNA, 20 bp, Artificial Sequence
  Primer
attacaggcatgagccactg

SEQ ID NO: 257 - DNA, 21 bp, Artificial Sequence
  Primer
ataataagctggactccgagc

SEQ ID NO: 258 - DNA, 19 bp, Artificial Sequence
  Primer
gtgggaggatcacttgagc

SEQ ID NO: 259 - DNA, 19 bp, Artificial Sequence
  Primer
acccctccgggtcagctcc

SEQ ID NO: 260 - DNA, 20 bp, Artificial Sequence
  Primer
taataagctggactccgagc

SEQ ID NO: 261 - DNA, 18 bp, Artificial Sequence
  Primer
gacccctctctccctcca

SEQ ID NO: 262 - DNA, 18 bp, Artificial Sequence
  Primer
gacccctctctccctcca

SEQ ID NO: 263 - DNA, 19 bp, Artificial Sequence
  Primer
tgggctggagcacaatgac

SEQ ID NO: 264 - DNA, 20 bp, Artificial Sequence
  Primer
gagtccgcagctctttgaac

SEQ ID NO: 265 - DNA, 19 bp, Artificial Sequence
  Primer
ttgcaagaccccgtctctg

SEQ ID NO: 266 - DNA, 19 bp, Artificial Sequence
  Primer
ttgcaagaccccgtctctg

SEQ ID NO: 267 - DNA, 19 bp, Artificial Sequence
  Primer
ccagtcccctgctgtctgt

SEQ ID NO: 268 - DNA, 18 bp, Artificial Sequence
  Primer
gagggtgccaggcagctg

SEQ ID NO: 269 - DNA, 23 bp, Artificial Sequence
  Primer
tacctggtgaccttgaatgtgat

SEQ ID NO: 270 - DNA, 24 bp, Artificial Sequence
  Primer
cttccatcctcatttttttttatt

SEQ ID NO: 271 - DNA, 20 bp, Artificial Sequence
  Primer
gctcagaagaggtgcttcac

SEQ ID NO: 272 - DNA, 18 bp, Artificial Sequence
  Primer
cagaagcccgtctgggct

SEQ ID NO: 273 - DNA, 18 bp, Artificial Sequence
  Primer
cagaagcccgtctgggct

SEQ ID NO: 274 - DNA, 21 bp, Artificial Sequence
  Primer
agagtccgcagctctttgaac

SEQ ID NO: 275 - DNA, 18 bp, Artificial Sequence
  Primer
ccgagactgggaacagcc

SEQ ID NO: 276 - DNA, 18 bp, Artificial Sequence
  Primer
ccgagactgggaacagcc

SEQ ID NO: 277 - DNA, 18 bp, Artificial Sequence
  Primer
ggaccatggtgcacagca

SEQ ID NO: 278 - DNA, 19 bp, Artificial Sequence
  Primer
agtaacctgcgcagctggg

SEQ ID NO: 279 - DNA, 18 bp, Artificial Sequence
  Primer
gtaacctgcgcagctggg

SEQ ID NO: 280 - DNA, 21 bp, Artificial Sequence
  Primer
gttaccatgttagggaggaga

SEQ ID NO: 281 - DNA, 18 bp, Artificial Sequence
  Primer
accatgttagggaggaga

SEQ ID NO: 282 - DNA, 20 bp, Artificial Sequence
  Primer
ggacattgagggtgagctaa

SEQ ID NO: 283 - DNA, 18 bp, Artificial Sequence
  Primer
acattgagggtgagctaa

SEQ ID NO: 284 - DNA, 18 bp, Artificial Sequence
  Primer
ggagtgtccctggacccc

SEQ ID NO: 285 - DNA, 18 bp, Artificial Sequence
  Primer
tgcgctgccaagtggagg

SEQ ID NO: 286 - DNA, 22 bp, Artificial Sequence
  Primer
gctcagtgtactgcaatggctc

SEQ ID NO: 287 - DNA, 18 bp, Artificial Sequence
  Primer
agtgtactgcaatggctc

SEQ ID NO: 288 - DNA, 20 bp, Artificial Sequence
  Primer
cttgcagtgagcccagatcg

SEQ ID NO: 289 - DNA, 22 bp, Artificial Sequence
  Primer
aagagacacacctaatttgtgg

SEQ ID NO: 290 - DNA, 18 bp, Artificial Sequence
  Primer
cgcgtggatgtcagggcc

SEQ ID NO: 291 - DNA, 21 bp, Artificial Sequence
  Primer
cagaccttgaaccagatagaa

SEQ ID NO: 292 - DNA, 18 bp, Artificial Sequence
  Primer
accttgaaccagatagaa

SEQ ID NO: 293 - DNA, 19 bp, Artificial Sequence
  Primer
ctcccagacagagtgcatg

SEQ ID NO: 294 - DNA, 18 bp, Artificial Sequence
  Primer
tcccagacagagtgcatg

SEQ ID NO: 295 - DNA, 18 bp, Artificial Sequence
  Primer
ggcgagtacgagtgcgca

SEQ ID NO: 296 - DNA, 17 bp, Artificial Sequence
  Primer
agagacagggtctcgcc

SEQ ID NO: 297 - DNA, 17 bp, Artificial Sequence
  Primer
ctccctctcggtcccgg

SEQ ID NO: 298 - DNA, 17 bp, Artificial Sequence
  Primer
agtttcctatcccagcc

SEQ ID NO: 299 - DNA, 18 bp, Artificial Sequence
  Primer
ccagaacctcagggtatg

SEQ ID NO: 300 - DNA, 18 bp, Artificial Sequence
  Primer
cttctgtaagtctgtggg

SEQ ID NO: 301 - DNA, 17 bp, Artificial Sequence
  Primer
gggttcaggtcacaccc

SEQ ID NO: 302 - DNA, 21 bp, Artificial Sequence
  Primer
ttctgtctcaaaaaacaaagc

SEQ ID NO: 303 - DNA, 17 bp, Artificial Sequence
  Primer
cccgccactgcactcca

SEQ ID NO: 304 - DNA, 17 bp, Artificial Sequence
  Primer
tccttctgagttctccc

SEQ ID NO: 305 - DNA, 17 bp, Artificial Sequence
  Primer
tggattctacctttccc

SEQ ID NO: 306 - DNA, 20 bp, Artificial Sequence
  Primer
tgttgatgcgtgggttgggg

SEQ ID NO: 307 - DNA, 17 bp, Artificial Sequence
  Primer
cggggtgggtggatcaa

SEQ ID NO: 308 - DNA, 17 bp, Artificial Sequence
  Primer
actccctgccctggccc

SEQ ID NO: 309 - DNA, 19 bp, Artificial Sequence
  Primer
gcagctgcaccgacagttc

SEQ ID NO: 310 - DNA, 20 bp, Artificial Sequence
  Primer
tcggctgcccgtgccaagtc

SEQ ID NO: 311 - DNA, 17 bp, Artificial Sequence
  Primer
ataccatgccaggcatt

SEQ ID NO: 312 - DNA, 19 bp, Artificial Sequence
  Primer
cccagggtgacgttgcaga

SEQ ID NO: 313 - DNA, 30 bp, Artificial Sequence
  Primer
acgttggatgagggttgcagagcaggagaa

SEQ ID NO: 314 - DNA, 30 bp, Artificial Sequence
  Primer
acgttggatgagccaaggtgacgctgaatg

SEQ ID NO: 315 - DNA, 30 bp, Artificial Sequence
  Primer
acgttggatgagatggtgacagtaacctgc

SEQ ID NO: 316 - DNA, 30 bp, Artificial Sequence
  Primer
acgttggatgtggcatttagctgaagctgg

SEQ ID NO: 317 - DNA, 23 bp, Artificial Sequence
  Primer
ccttcagcaggagctgggccctc

SEQ ID NO: 318 - DNA, 17 bp, Artificial Sequence
  Primer
taacctgcgcagctggg

SEQ ID NO: 319 - DNA, 30 bp, Artificial Sequence
  Primer
acgttggatgatccgcatgtgtctgtattc

SEQ ID NO: 320 - DNA, 30 bp, Artificial Sequence
  Primer
acgttggatgcccagtgcattatgtcttgg

SEQ ID NO: 321 - DNA, 30 bp, Artificial Sequence
  Primer
acgttggatgtgccagtgctctgaaaactg

SEQ ID NO: 322 - DNA, 30 bp, Artificial Sequence
  Primer
acgttggatgcctgtggtctctattgcttg

SEQ ID NO: 323 - DNA, 30 bp, Artificial Sequence
  Primer
acgttggatgacaagaatgccagtgctctg

SEQ ID NO: 324 - DNA, 30 bp, Artificial Sequence; identical to SEQ ID NO: 322
  Primer

SEQ ID NO: 325 - DNA, 30 bp, Artificial Sequence
  Primer
acgttggatgtaatctcagaatggcagcac

SEQ ID NO: 326 - DNA, 30 bp, Artificial Sequence
  Primer
acgttggatgtcaagcaatagagaccacag

SEQ ID NO: 327 - DNA, 35 bp, Artificial Sequence
  Primer
acgttggatgttcaagaattattttattgcaagtc

SEQ ID NO: 328 - DNA, 30 bp, Artificial Sequence
  Primer
acgttggatgggtgaagcttgaaagcaagc

SEQ ID NO: 329 - DNA, 30 bp, Artificial Sequence
  Primer
acgttggatgttaatgtagtaaaaagcacg

SEQ ID NO: 330 - DNA, 30 bp, Artificial Sequence
  Primer
acgttggatgctagagatcggttttacacc

SEQ ID NO: 331 - DNA, 30 bp, Artificial Sequence
  Primer
acgttggatgactggttgataccataggac

SEQ ID NO: 332 - DNA, 30 bp, Artificial Sequence
  Primer
acgttggatgtgtactgctttcatccttgc

SEQ ID NO: 333 - DNA, 30 bp, Artificial Sequence; identical to SEQ ID NO: 331
  Primer

SEQ ID NO: 334 - DNA, 30 bp, Artificial Sequence; identical to SEQ ID NO: 332
  Primer

SEQ ID NO: 335 - DNA, 31 bp, Artificial Sequence
  Primer
acgttggatgcagaggaaagaaaactgaaag

SEQ ID NO: 336 - DNA, 30 bp, Artificial Sequence
  Primer
acgttggatgggatttgttcttaatctttc

SEQ ID NO: 337 - DNA, 30 bp, Artificial Sequence
  Primer
acgttggatgcaaatgggagtcaagtcctc

SEQ ID NO: 338 - DNA, 30 bp, Artificial Sequence
  Primer
acgttggatgttttgctcctaagctgaagg

SEQ ID NO: 339 - DNA, 30 bp, Artificial Sequence
  Primer
acgttggatgggaattgaaattggcattgc

SEQ ID NO: 340 - DNA, 30 bp, Artificial Sequence
  Primer
acgttggatgattggaaggaggaagcatag

SEQ ID NO: 341 - DNA, 30 bp, Artificial Sequence
  Primer
acgttggatggagttgccagtagctttgag

SEQ ID NO: 342 - DNA, 30 bp, Artificial Sequence
  Primer
acgttggatgattgtttccagggtgctctg

SEQ ID NO: 343 - DNA, 30 bp, Artificial Sequence
  Primer
acgttggatggtgcaatcttggttcactgc

SEQ ID NO: 344 - DNA, 30 bp, Artificial Sequence
  Primer
acgttggatggcttacactagctacttggg

SEQ ID NO: 345 - DNA, 30 bp, Artificial Sequence
  Primer
acgttggatgagcactgtgagttaaacctg

SEQ ID NO: 346 - DNA, 30 bp, Artificial Sequence
  Primer
acgttggatgctgtatagagagctgtttgc

SEQ ID NO: 347 - DNA, 30 bp, Artificial Sequence
  Primer
acgttggatgctatggcagcagaagagtag

SEQ ID NO: 348 - DNA, 30 bp, Artificial Sequence
  Primer
acgttggatgaatgttggaccacatgtacg

SEQ ID NO: 349 - DNA, 30 bp, Artificial Sequence
  Primer
acgttggatgcatggcgaggaaatctgttt

SEQ ID NO: 350 - DNA, 30 bp, Artificial Sequence
  Primer
acgttggatgttcgatatatcagagccttg

SEQ ID NO: 351 - DNA, 30 bp, Artificial Sequence
  Primer
acgttggatgatactgagctccattttggg

SEQ ID NO: 352 - DNA, 30 bp, Artificial Sequence
  Primer
acgttggatgatggcacagtttagcatgtc

SEQ ID NO: 353 - DNA, 31 bp, Artificial Sequence
  Primer
acgttggatggcccatgttaacattttcttc

SEQ ID NO: 354 - DNA, 31 bp, Artificial Sequence
  Primer
acgttggatgctgattattctgatggtaatg

SEQ ID NO: 355 - DNA, 30 bp, Artificial Sequence
  Primer
acgttggatggcaggaggatagatctgtag

SEQ ID NO: 356 - DNA, 30 bp, Artificial Sequence
  Primer
acgttggatgtagcttctaaacatctcttg

SEQ ID NO: 357 - DNA, 30 bp, Artificial Sequence
  Primer
acgttggatgtggctttctgaatgctagag

SEQ ID NO: 358 - DNA, 30 bp, Artificial Sequence
  Primer
acgttggatgagggcggaatgatttttagc

SEQ ID NO: 359 - DNA, 30 bp, Artificial Sequence
  Primer
acgttggatggcactacatgggacacaaag

SEQ ID NO: 360 - DNA, 30 bp, Artificial Sequence
  Primer
acgttggatggtcctactagtccctgtatg

SEQ ID NO: 361 - DNA, 30 bp, Artificial Sequence
  Primer
acgttggatggctgagggagaaattgagtg

SEQ ID NO: 362 - DNA, 30 bp, Artificial Sequence
  Primer
acgttggatgctgtgccttgcacatagtag

SEQ ID NO: 363 - DNA, 30 bp, Artificial Sequence
  Primer
acgttggatgtttcattgctcatggattag

SEQ ID NO: 364 - DNA, 31 bp, Artificial Sequence
  Primer
acgttggatggataagtattggcttaatctg

SEQ ID NO: 365 - DNA, 30 bp, Artificial Sequence
  Primer
acgttggatgaacaacttggctaattctac

SEQ ID NO: 366 - DNA, 30 bp, Artificial Sequence
  Primer
acgttggatggtcattgcctctagctagtg

SEQ ID NO: 367 - DNA, 30 bp, Artificial Sequence
  Primer
acgttggatgaccagcactattacccatgc

SEQ ID NO: 368 - DNA, 30 bp, Artificial Sequence
  Primer
acgttggatggaatgatgtaaacgttggag

SEQ ID NO: 369 - DNA, 30 bp, Artificial Sequence
  Primer
acgttggatggtgatgaaaaccatgtgagc

SEQ ID NO: 370 - DNA, 30 bp, Artificial Sequence
  Primer
acgttggatgctggagaacaaaagaccacc

SEQ ID NO: 371 - DNA, 30 bp, Artificial Sequence
  Primer
acgttggatgcaaggcaaaatgtttccagc

SEQ ID NO: 372 - DNA, 30 bp, Artificial Sequence
  Primer
acgttggatgaacacacttagtacccacgc

SEQ ID NO: 373 - DNA, 30 bp, Artificial Sequence
  Primer
acgttggatgtactgcagagctctcccttg

SEQ ID NO: 374 - DNA, 30 bp, Artificial Sequence
  Primer
acgttggatgagaggtcatcttaatgggcc

SEQ ID NO: 375 - DNA, 30 bp, Artificial Sequence
  Primer
acgttggatgtcatactgatcaacctgaag

SEQ ID NO: 376 - DNA, 30 bp, Artificial Sequence
  Primer
acgttggatgggtggctttgtgaaaccttg

SEQ ID NO: 377 - DNA, 30 bp, Artificial Sequence
  Primer
acgttggatggcatggttctgttataaggc

SEQ ID NO: 378 - DNA, 30 bp, Artificial Sequence
  Primer
acgttggatgacacttgattacaatggccc

SEQ ID NO: 379 - DNA, 31 bp, Artificial Sequence
  Primer
acgttggatgcacgcctaagcaattaatgac

SEQ ID NO: 380 - DNA, 30 bp, Artificial Sequence
  Primer
acgttggatggtgaatgaaggaaaagtagc

SEQ ID NO: 381 - DNA, 30 bp, Artificial Sequence
  Primer
acgttggatgtgattactggattggctggg

SEQ ID NO: 382 - DNA, 30 bp, Artificial Sequence
  Primer
acgttggatgaaatgccctgaagacccagc

SEQ ID NO: 383 - DNA, 30 bp, Artificial Sequence
  Primer
acgttggatgggaatgcattgtaaaccagg

SEQ ID NO: 384 - DNA, 30 bp, Artificial Sequence
  Primer
acgttggatgacctagccttgcaggaggac

SEQ ID NO: 385 - DNA, 30 bp, Artificial Sequence
  Primer
acgttggatgatagtgttatcacatagacc

SEQ ID NO: 386 - DNA, 30 bp, Artificial Sequence
  Primer
acgttggatgctccaggagcaaggattatg

SEQ ID NO: 387 - DNA, 30 bp, Artificial Sequence
  Primer
acgttggatggtgggtaacagttttcaggc

SEQ ID NO: 388 - DNA, 30 bp, Artificial Sequence
  Primer
acgttggatgctctcctactctttactgtc

SEQ ID NO: 389 - DNA, 30 bp, Artificial Sequence
  Primer
acgttggatgtcgtacctgcataagtggtg

SEQ ID NO: 390 - DNA, 30 bp, Artificial Sequence
  Primer
acgttggatgttgggaaggtactaacagcg

SEQ ID NO: 391 - DNA, 30 bp, Artificial Sequence
  Primer
acgttggatggatgccaatttggtttgccc

SEQ ID NO: 392 - DNA, 30 bp, Artificial Sequence
  Primer
acgttggatggaaggataagccacagtgag

SEQ ID NO: 393 - DNA, 30 bp, Artificial Sequence
  Primer
acgttggatgcttcaagaggccatacagac

SEQ ID NO: 394 - DNA, 30 bp, Artificial Sequence
  Primer
acgttggatgaagcaccatttgtggctcag

SEQ ID NO: 395 - DNA, 30 bp, Artificial Sequence
  Primer
acgttggatgctttcctgctgcatttagtg

SEQ ID NO: 396 - DNA, 30 bp, Artificial Sequence
  Primer
acgttggatgtaagccagtaacacatgccg

SEQ ID NO: 397 - DNA, 30 bp, Artificial Sequence
  Primer
acgttggatggccctgaagtttttgaatgg

SEQ ID NO: 398 - DNA, 30 bp, Artificial Sequence
  Primer
acgttggatggagcccaatacaatcaggtg

SEQ ID NO: 399 - DNA, 30 bp, Artificial Sequence
  Primer
acgttggatgttcactgctaacatgcatgg

SEQ ID NO: 400 - DNA, 30 bp, Artificial Sequence
  Primer
acgttggatgttatatagccttcttttctc

SEQ ID NO: 401 - DNA, 30 bp, Artificial Sequence
  Primer
acgttggatgggataggaaacatattaagg

SEQ ID NO: 402 - DNA, 30 bp, Artificial Sequence
  Primer
acgttggatgctgtgtgatttggacaaccc

SEQ ID NO: 403 - DNA, 30 bp, Artificial Sequence
  Primer
acgttggatgagactgtagcctaaatgagg

SEQ ID NO: 404 - DNA, 30 bp, Artificial Sequence
  Primer
acgttggatgcattttatgagaagatgcac

SEQ ID NO: 405 - DNA, 30 bp, Artificial Sequence
  Primer
acgttggatggcaactcagctagcctttac

SEQ ID NO: 406 - DNA, 30 bp, Artificial Sequence
  Primer
acgttggatgtgttatgcgggagtataagg

SEQ ID NO: 407 - DNA, 30 bp, Artificial Sequence
  Primer
acgttggatgtgaatcatggttgcctcctg

SEQ ID NO: 408 - DNA, 30 bp, Artificial Sequence
  Primer
acgttggatgatacgcaggttgtagagagg

SEQ ID NO: 409 - DNA, 30 bp, Artificial Sequence
  Primer
acgttggatgtatacattgtcctgatagag

SEQ ID NO: 410 - DNA, 31 bp, Artificial Sequence
  Primer
acgttggatgcttaaatgtctctagaaaagg

SEQ ID NO: 411 - DNA, 31 bp, Artificial Sequence
  Primer
acgttggatgcacctgtataccaatttgtag

SEQ ID NO: 412 - DNA, 30 bp, Artificial Sequence
  Primer
acgttggatggccaaaccattttgtgcctg

SEQ ID NO: 413 - DNA, 30 bp, Artificial Sequence
  Primer
acgttggatgcatactctgccaaagtttta

SEQ ID NO: 414 - DNA, 30 bp, Artificial Sequence
  Primer
acgttggatgactcacactgtggtttgggg

SEQ ID NO: 415 - DNA, 30 bp, Artificial Sequence
  Primer
acgttggatgccaggcaaaaagaatgaccg

SEQ ID NO: 416 - DNA, 30 bp, Artificial Sequence
  Primer
acgttggatgaatgatatgcaccgatcttc

SEQ ID NO: 417 - DNA, 30 bp, Artificial Sequence
  Primer
acgttggatgtcatgtagctaaacaaaggc

SEQ ID NO: 418 - DNA, 30 bp, Artificial Sequence
  Primer
acgttggatgagcagggttaaatttcccag

SEQ ID NO: 419 - DNA, 30 bp, Artificial Sequence
  Primer
acgttggatgaagaacattgaaagaagcag

SEQ ID NO: 420 - DNA, 30 bp, Artificial Sequence
  Primer
acgttggatggtatttaaattagtggtgtg

SEQ ID NO: 421 - DNA, 30 bp, Artificial Sequence
  Primer
acgttggatgtcccagtacctaagtagcag

SEQ ID NO: 422 - DNA, 30 bp, Artificial Sequence
  Primer
acgttggatggctttgaattactctgtccc

SEQ ID NO: 423 - DNA, 30 bp, Artificial Sequence
  Primer
acgttggatgtacaactagtatctacagac

SEQ ID NO: 424 - DNA, 31 bp, Artificial Sequence
  Primer
acgttggatggtgaccatgtagaaatctgtg

SEQ ID NO: 425 - DNA, 31 bp, Artificial Sequence
  Primer
acgttggatggaacatgaaaaattcataagc

SEQ ID NO: 426 - DNA, 30 bp, Artificial Sequence
  Primer
acgttggatgaagtttccctggtcgtgatc

SEQ ID NO: 427 - DNA, 30 bp, Artificial Sequence
  Primer
acgttggatgctgtttttcacccccgattc

SEQ ID NO: 428 - DNA, 30 bp, Artificial Sequence
  Primer
acgttggatgctgaggagtccatcatagtg

SEQ ID NO: 429 - DNA, 30 bp, Artificial Sequence
  Primer
acgttggatggaaacaagcagatgtcatgg

SEQ ID NO: 430 - DNA, 31 bp, Artificial Sequence
  Primer
acgttggatggcttctgattttatatggcac

SEQ ID NO: 431 - DNA, 30 bp, Artificial Sequence
  Primer
acgttggatggggagagaatggttgcatat

SEQ ID NO: 432 - DNA, 30 bp, Artificial Sequence
  Primer
acgttggatgatgctgaacaacaggatggg

SEQ ID NO: 433 - DNA, 30 bp, Artificial Sequence
  Primer
acgttggatgcctaagacctatgctctcac

SEQ ID NO: 434 - DNA, 30 bp, Artificial Sequence
  Primer
acgttggatgcccatttttgctagcaggag

SEQ ID NO: 435 - DNA, 30 bp, Artificial Sequence
  Primer
acgttggatgcaagagggctgctttaaacc

SEQ ID NO: 436 - DNA, 30 bp, Artificial Sequence
  Primer
acgttggatgtaaatttgcagaggccgtcg

SEQ ID NO: 437 - DNA, 30 bp, Artificial Sequence
  Primer
acgttggatgaaaaggtcaccagtgacctg

SEQ ID NO: 438 - DNA, 30 bp, Artificial Sequence
  Primer
acgttggatgtagtccaagtatttcccaag

SEQ ID NO: 439 - DNA, 30 bp, Artificial Sequence
  Primer
acgttggatggatatctccctcctattggc

SEQ ID NO: 440 - DNA, 30 bp, Artificial Sequence
  Primer
acgttggatggctggactctattaggccat

SEQ ID NO: 441 - DNA, 30 bp, Artificial Sequence
  Primer
acgttggatggatctctgatcttagaccac

SEQ ID NO: 442 - DNA, 30 bp, Artificial Sequence
  Primer
acgttggatgtgcagatatgtaggccaagc

SEQ ID NO: 443 - DNA, 30 bp, Artificial Sequence
  Primer
acgttggatggaccagcaaccatgatgaag

SEQ ID NO: 444 - DNA, 30 bp, Artificial Sequence
  Primer
acgttggatggttctactttgaccacaggc

SEQ ID NO: 445 - DNA, 30 bp, Artificial Sequence
  Primer
acgttggatgtagcaccttcaggatctttc

SEQ ID NO: 446 - DNA, 30 bp, Artificial Sequence
  Primer
acgttggatgaatcatgatcccagggcaag

SEQ ID NO: 447 - DNA, 31 bp, Artificial Sequence
  Primer
acgttggatggtaatccataaactgtgggag

SEQ ID NO: 448 - DNA, 30 bp, Artificial Sequence
  Primer
acgttggatgtcccaccctgacttctttgc

SEQ ID NO: 449 - DNA, 18 bp, Artificial Sequence
  Primer
ttatgtcttggtagagcc

SEQ ID NO: 450 - DNA, 22 bp, Artificial Sequence
  Primer
tctattgcttgaagagagaaag

SEQ ID NO: 451 - DNA, 18 bp, Artificial Sequence
  Primer
ttgcttgaagagagaaag

SEQ ID NO: 452 - DNA, 19 bp, Artificial Sequence
  Primer
ccacctgcaccatcgccat

SEQ ID NO: 453 - DNA, 18 bp, Artificial Sequence
  Primer
agctaaattgcaacaaca

SEQ ID NO: 454 - DNA, 24 bp, Artificial Sequence
  Primer
attgaactgtatacttaaaaatgc

SEQ ID NO: 455 - DNA, 19 bp, Artificial Sequence
  Primer
actctcccactgagcaagc

SEQ ID NO: 456 - DNA, 19 bp, Artificial Sequence
  Primer
actctcccactgagcaagc

SEQ ID NO: 457 - DNA, 24 bp, Artificial Sequence
  Primer
ttgaaatactgtttgtttccccaa

SEQ ID NO: 458 - DNA, 20 bp, Artificial Sequence
  Primer
tcctaagctgaagggaatgc

SEQ ID NO: 459 - DNA, 21 bp, Artificial Sequence
  Primer
gaggaagcatagatttggtgt

SEQ ID NO: 460 - DNA, 21 bp, Artificial Sequence
  Primer
ccagggtgctctggtttaatt

SEQ ID NO: 461 - DNA, 17 bp, Artificial Sequence
  Primer
ggcttaaacctgggagg

SEQ ID NO: 462 - DNA, 23 bp, Artificial Sequence
  Primer
gagctgtttgcatttataactca

SEQ ID NO: 463 - DNA, 20 bp, Artificial Sequence
  Primer
accacatgtacgtaagggga

SEQ ID NO: 464 - DNA, 22 bp, Artificial Sequence
  Primer
aaacaccatctactctgaagaa

SEQ ID NO: 465 - DNA, 22 bp, Artificial Sequence
  Primer
cttatattctctgtggcaccaa

SEQ ID NO: 466 - DNA, 24 bp, Artificial Sequence
  Primer
attattctgatggtaatgatccag

SEQ ID NO: 467 - DNA, 23 bp, Artificial Sequence
  Primer
ctaaacatctcttgaatattctg

SEQ ID NO: 468 - DNA, 22 bp, Artificial Sequence
  Primer
tgatttttagctaaaggggaca

SEQ ID NO: 469 - DNA, 19 bp, Artificial Sequence
  Primer
cctcttgtcttattatccc

SEQ ID NO: 470 - DNA, 18 bp, Artificial Sequence
  Primer
gcacatagtagtagctca

SEQ ID NO: 471 - DNA, 24 bp, Artificial Sequence
  Primer
attggcttaatctgtacatcaatt

SEQ ID NO: 472 - DNA, 24 bp, Artificial Sequence
  Primer
gtggggttagatattatttcctga

SEQ ID NO: 473 - DNA, 21 bp, Artificial Sequence
  Primer
gataaatgtgagattgagaga

SEQ ID NO: 474 - DNA, 23 bp, Artificial Sequence
  Primer
cctgtgttcctttgtatttatat

SEQ ID NO: 475 - DNA, 21 bp, Artificial Sequence
  Primer
cggcttctactctcttattca

SEQ ID NO: 476 - DNA, 17 bp, Artificial Sequence
  Primer
gtcacattcttaccctc

SEQ ID NO: 477 - DNA, 17 bp, Artificial Sequence
  Primer
gaaaccttgcatgaact

SEQ ID NO: 478 - DNA, 20 bp, Artificial Sequence
  Primer
cagaagctacttttccttca

SEQ ID NO: 479 - DNA, 19 bp, Artificial Sequence
  Primer
aggaaaagtagcttctggg

SEQ ID NO: 480 - DNA, 17 bp, Artificial Sequence
  Primer
gctagactcctgatacc

SEQ ID NO: 481 - DNA, 20 bp, Artificial Sequence
  Primer
ggcttgctcctggtaattta

SEQ ID NO: 482 - DNA, 20 bp, Artificial Sequence
  Primer
caaggattatgttaaccact

SEQ ID NO: 483 - DNA, 17 bp, Artificial Sequence
  Primer
tattcacacctgccttc

SEQ ID NO: 484 - DNA, 17 bp, Artificial Sequence
  Primer
gttcttgcctggtttac

SEQ ID NO: 485 - DNA, 18 bp, Artificial Sequence
  Primer
ggaatgagggcaacagga

SEQ ID NO: 486 - DNA, 17 bp, Artificial Sequence
  Primer
tgtggctcaggtccagg

SEQ ID NO: 487 - DNA, 20 bp, Artificial Sequence
  Primer
cttcctggacattaaattgt

SEQ ID NO: 488 - DNA, 20 bp, Artificial Sequence
  Primer
ggatgcatggtttctctaat

SEQ ID NO: 489 - DNA, 22 bp, Artificial Sequence
  Primer
ttcttttctcttttaggaatct

SEQ ID NO: 490 - DNA, 17 bp, Artificial Sequence
  Primer
gtgctaggatcctcagt

SEQ ID NO: 491 - DNA, 23 bp, Artificial Sequence
  Primer
gttttagcataattgcttcttta

SEQ ID NO: 492 - DNA, 17 bp, Artificial Sequence
  Primer
gagaagaaacctgccca

SEQ ID NO: 493 - DNA, 17 bp, Artificial Sequence
  Primer
agggctgcagggaagat

SEQ ID NO: 494 - DNA, 22 bp, Artificial Sequence
  Primer
agaaaaggtttttaaagtcctc

SEQ ID NO: 495 - DNA, 18 bp, Artificial Sequence
  Primer
gaaaactgttacccactc

SEQ ID NO: 496 - DNA, 17 bp, Artificial Sequence
  Primer
ggtttgggggtttcatt

SEQ ID NO: 497 - DNA, 20 bp, Artificial Sequence
  Primer
tgcaccgatcttcaaataaa

SEQ ID NO: 498 - DNA, 23 bp, Artificial Sequence
  Primer
tttcccagattaattatcagatt

SEQ ID NO: 499 - DNA, 18 bp, Artificial Sequence
  Primer
ttagtggtgtgacttgca

SEQ ID NO: 500 - DNA, 19 bp, Artificial Sequence
  Primer
cgaatctctttaactgctg

SEQ ID NO: 501 - DNA, 21 bp, Artificial Sequence
  Primer
ggtttcttctaaaactgacct

SEQ ID NO: 502 - DNA, 24 bp, Artificial Sequence
  Primer
ttttttgggatcttgatattttta

SEQ ID NO: 503 - DNA, 24 bp, Artificial Sequence
  Primer
aacttatgaaagaatatgaaggat

SEQ ID NO: 504 - DNA, 21 bp, Artificial Sequence
  Primer
taagagaagtcttcagtgctt

SEQ ID NO: 505 - DNA, 24 bp, Artificial Sequence
  Primer
gcagagatttttcaaaatctctaa

SEQ ID NO: 506 - DNA, 23 bp, Artificial Sequence
  Primer
tttttaaagctgaaaataaacca

SEQ ID NO: 507 - DNA, 17 bp, Artificial Sequence
  Primer
gccgtcgaacaaatact

SEQ ID NO: 508 - DNA, 17 bp, Artificial Sequence
  Primer
tatttcccaagtgccca

SEQ ID NO: 509 - DNA, 17 bp, Artificial Sequence
  Primer
ctgtcagttgccttagg

SEQ ID NO: 510 - DNA, 17 bp, Artificial Sequence
  Primer
agtcaagaccagctggg

SEQ ID NO: 511 - DNA, 17 bp, Artificial Sequence
  Primer
ctctttcttctgatccc

SEQ ID NO: 512 - DNA, 17 bp, Artificial Sequence
  Primer
agtgcattacagtggtc

SEQ ID NO: 513 - DNA, 23 bp, Artificial Sequence
  Primer
tttgcttatttcatagaaggaat

SEQ ID NO: 514 - DNA, 30 bp, Artificial Sequence
  Primer
acgttggatgtgagtgacatttgtgtcacc

SEQ ID NO: 515 - DNA, 30 bp, Artificial Sequence
  Primer
acgttggatgcggaggatctgaacaacttc

SEQ ID NO: 516 - DNA, 30 bp, Artificial Sequence
  Primer
acgttggatgtcacctgagcatcagacatg

SEQ ID NO: 517 - DNA, 30 bp, Artificial Sequence
  Primer
acgttggatgatagtggaaggagaaacggg

SEQ ID NO: 518 - DNA, 30 bp, Artificial Sequence
  Primer
acgttggatggttctaatgtcaccccttcc

SEQ ID NO: 519 - DNA, 30 bp, Artificial Sequence
  Primer
acgttggatgcaatgtggcaaattctctgg

SEQ ID NO: 520 - DNA, 30 bp, Artificial Sequence
  Primer
acgttggatgcacacattcttctcaagtgc

SEQ ID NO: 521 - DNA, 30 bp, Artificial Sequence
  Primer
acgttggatgggagggacacaatttaactc

SEQ ID NO: 522 - DNA, 30 bp, Artificial Sequence
  Primer
acgttggatggggagtcattccaataccag

SEQ ID NO: 523 - DNA, 30 bp, Artificial Sequence
  Primer
acgttggatgggagtgaaaggtcatattgg

SEQ ID NO: 524 - DNA, 30 bp, Artificial Sequence
  Primer
acgttggatgatcactgcaacctccacctc

SEQ ID NO: 525 - DNA, 30 bp, Artificial Sequence
  Primer
acgttggatgtgtggcatgagcctgtaatc

SEQ ID NO: 526 - DNA, 30 bp, Artificial Sequence
  Primer
acgttggatgaagcctcagatgaggcatac

SEQ ID NO: 527 - DNA, 30 bp, Artificial Sequence
  Primer
acgttggatgtctgaaagggttcaggaagg

SEQ ID NO: 528 - DNA, 30 bp, Artificial Sequence
  Primer
acgttggatgcaaatcacccctgacaattc

SEQ ID NO: 529 - DNA, 30 bp, Artificial Sequence
  Primer
acgttggatgaccagcacactcagctttag

SEQ ID NO: 530 - DNA, 30 bp, Artificial Sequence
  Primer
acgttggatgtcacctgaggtcaggagttg

SEQ ID NO: 531 - DNA, 30 bp, Artificial Sequence
  Primer
acgttggatgaggtttcaccatgttagccg

SEQ ID NO: 532 - DNA, 30 bp, Artificial Sequence
  Primer
acgttggatgctgcagttatctgggtgagc

SEQ ID NO: 533 - DNA, 30 bp, Artificial Sequence
  Primer
acgttggatgccagaacgtggcttgttggg

SEQ ID NO: 534 - DNA, 30 bp, Artificial Sequence
  Primer
acgttggatgcgttgatgcactgaagggag

SEQ ID NO: 535 - DNA, 30 bp, Artificial Sequence
  Primer
acgttggatgagaggctaaatgttggcagg

SEQ ID NO: 536 - DNA, 30 bp, Artificial Sequence
  Primer
acgttggatgtgtatctgatcccaggtcac

SEQ ID NO: 537 - DNA, 30 bp, Artificial Sequence
  Primer
acgttggatgattggtgttaagtggcgtgc

SEQ ID NO: 538 - DNA, 30 bp, Artificial Sequence
  Primer
acgttggatgtgaggacctcattattggtg

SEQ ID NO: 539 - DNA, 30 bp, Artificial Sequence
  Primer
acgttggatgctgagcaatcgaactgctac

SEQ ID NO: 540 - DNA, 30 bp, Artificial Sequence
  Primer
acgttggatgaatatcctaggctagcagtg

SEQ ID NO: 541 - DNA, 30 bp, Artificial Sequence
  Primer
acgttggatggtgcataaatacatgaatag

SEQ ID NO: 542 - DNA, 30 bp, Artificial Sequence
  Primer
acgttggatgacagagaggcttggtcatac

SEQ ID NO: 543 - DNA, 30 bp, Artificial Sequence
  Primer
acgttggatgggtgcttggttgtgattctc

SEQ ID NO: 544 - DNA, 30 bp, Artificial Sequence
  Primer
acgttggatgattcctgcaggtactgtgtc

SEQ ID NO: 545 - DNA, 30 bp, Artificial Sequence
  Primer
acgttggatgtgagcccaaaactactgctg

SEQ ID NO: 546 - DNA, 30 bp, Artificial Sequence
  Primer
acgttggatgatgaagtctcgctctgttgc

SEQ ID NO: 547 - DNA, 30 bp, Artificial Sequence
  Primer
acgttggatgaatcacttgaacccaggagg

SEQ ID NO: 548 - DNA, 29 bp, Artificial Sequence
  Primer
acgttggatgtctgggaccgtttaccgca

SEQ ID NO: 549 - DNA, 30 bp, Artificial Sequence
  Primer
acgttggatggaggagacccagggtatgag

SEQ ID NO: 550 - DNA, 29 bp, Artificial Sequence
  Primer
acgttggatgaccgggagctcccagtctg

SEQ ID NO: 551 - DNA, 30 bp, Artificial Sequence
  Primer
acgttggatgtgggaatcggttgagagccg

SEQ ID NO: 552 - DNA, 30 bp, Artificial Sequence
  Primer
acgttggatgtaaggcgcctgcagaggcga

SEQ ID NO: 553 - DNA, 30 bp, Artificial Sequence
  Primer
acgttggatggcagcaaagaattgcccggc

SEQ ID NO: 554 - DNA, 30 bp, Artificial Sequence
  Primer
acgttggatgatttgtagctttgccccagc

SEQ ID NO: 555 - DNA, 30 bp, Artificial Sequence
  Primer
acgttggatgtttgtgagctccaagttggg

SEQ ID NO: 556 - DNA, 31 bp, Artificial Sequence
  Primer
acgttggatggcattttaccaccatgtggtt

SEQ ID NO: 557 - DNA, 30 bp, Artificial Sequence
  Primer
acgttggatgccttcatgttaattctgccc

SEQ ID NO: 558 - DNA, 30 bp, Artificial Sequence
  Primer
acgttggatgcctctgagttccctcagttt

SEQ ID NO: 559 - DNA, 30 bp, Artificial Sequence
  Primer
acgttggatgttatcaccctgctgtcctac

SEQ ID NO: 560 - DNA, 30 bp, Artificial Sequence
  Primer
acgttggatgtggtacctccaggtaaaatg

SEQ ID NO: 561 - DNA, 30 bp, Artificial Sequence
  Primer
acgttggatgtccaggcagtcattttaccc

SEQ ID NO: 562 - DNA, 30 bp, Artificial Sequence
  Primer
acgttggatggaaggtggagcagacattag

SEQ ID NO: 563 - DNA, 30 bp, Artificial Sequence
  Primer
acgttggatgaccttagttataccaggcac

SEQ ID NO: 564 - DNA, 30 bp, Artificial Sequence
  Primer
acgttggatgttaagccagtccccacaagg

SEQ ID NO: 565 - DNA, 30 bp, Artificial Sequence
  Primer
acgttggatgttctctgcggaggaaagtgc

SEQ ID NO: 566 - DNA, 30 bp, Artificial Sequence
  Primer
acgttggatgctcctcctcagaggactaac

SEQ ID NO: 567 - DNA, 30 bp, Artificial Sequence
  Primer
acgttggatgagcccaaggactcatacaac

SEQ ID NO: 568 - DNA, 30 bp, Artificial Sequence
  Primer
acgttggatgaccacgcctggctaattttg

SEQ ID NO: 569 - DNA, 30 bp, Artificial Sequence
  Primer
acgttggatgaaacatggcgaaacccggtc

SEQ ID NO: 570 - DNA, 30 bp, Artificial Sequence
  Primer
acgttggatgctttactgagtgggcaaacg

SEQ ID NO: 571 - DNA, 30 bp, Artificial Sequence
  Primer
acgttggatgtctaagtggaactcagcagc

SEQ ID NO: 572 - DNA, 30 bp, Artificial Sequence
  Primer
acgttggatgaagttcctctggtggacaac

SEQ ID NO: 573 - DNA, 30 bp, Artificial Sequence
  Primer
acgttggatgaccaccagataaaatccctc

SEQ ID NO: 574 - DNA, 30 bp, Artificial Sequence
  Primer
acgttggatgttttgacagggcttgagtcc

SEQ ID NO: 575 - DNA, 30 bp, Artificial Sequence
  Primer
acgttggatggctgaaagccctcaatctag

SEQ ID NO: 576 - DNA, 30 bp, Artificial Sequence
  Primer
acgttggatgcaattgctcagaccttcacc

SEQ ID NO: 577 - DNA, 30 bp, Artificial Sequence
  Primer
acgttggatgaatgctagagacattgcacc

SEQ ID NO: 578 - DNA, 30 bp, Artificial Sequence
  Primer
acgttggatgctagaattacaggtgcacac

SEQ ID NO: 579 - DNA, 30 bp, Artificial Sequence
  Primer
acgttggatggccaagatggtgaaaccttg

SEQ ID NO: 580 - DNA, 31 bp, Artificial Sequence
  Primer
acgttggatgcacaatctgttagaatggtgg

SEQ ID NO: 581 - DNA, 30 bp, Artificial Sequence
  Primer
acgttggatgcgtcaagactgaatgcatag

SEQ ID NO: 582 - DNA, 30 bp, Artificial Sequence
  Primer
acgttggatggaaaatatagtcctacacaa

SEQ ID NO: 583 - DNA, 30 bp, Artificial Sequence; identical to SEQ ID NO: 581
  Primer

SEQ ID NO: 584 - DNA, 30 bp, Artificial Sequence
  Primer
acgttggatgtctcctaatgctatccctcc

SEQ ID NO: 585 - DNA, 30 bp, Artificial Sequence
  Primer
acgttggatgaacacatggacacaggaagg

SEQ ID NO: 586 - DNA, 30 bp, Artificial Sequence
  Primer
acgttggatgagggacatggatgaaattgg

SEQ ID NO: 587 - DNA, 30 bp, Artificial Sequence
  Primer
acgttggatgaattcccacctatgagtgag

SEQ ID NO: 588 - DNA, 30 bp, Artificial Sequence
  Primer
acgttggatgtgggtatatacccaaaggac

SEQ ID NO: 589 - DNA, 30 bp, Artificial Sequence
  Primer
acgttggatgggttggttccaagtctttgc

SEQ ID NO: 590 - DNA, 30 bp, Artificial Sequence
  Primer
acgttggatgcttcagttcagggagagatc

SEQ ID NO: 591 - DNA, 30 bp, Artificial Sequence
  Primer
acgttggatgatagggcccccagcataaaa

SEQ ID NO: 592 - DNA, 30 bp, Artificial Sequence
  Primer
acgttggatgtggtagagatgaggtcttgc

SEQ ID NO: 593 - DNA, 30 bp, Artificial Sequence
  Primer
acgttggatgaaaggcaggaggattgcttg

SEQ ID NO: 594 - DNA, 30 bp, Artificial Sequence
  Primer
acgttggatgtatgcttccagtctctgacc

SEQ ID NO: 595 - DNA, 30 bp, Artificial Sequence
  Primer
acgttggatgataggtaatccagttgggcc

SEQ ID NO: 596 - DNA, 30 bp, Artificial Sequence
  Primer
acgttggatgggtgtactctgccatttgtc

SEQ ID NO: 597 - DNA, 30 bp, Artificial Sequence
  Primer
acgttggatgtggaggaggttctagtaccc

SEQ ID NO: 598 - DNA, 30 bp, Artificial Sequence
  Primer
acgttggatggtctgccaaagttcccttag

SEQ ID NO: 599 - DNA, 30 bp, Artificial Sequence
  Primer
acgttggatgaggaaagggaagagaaaccg

SEQ ID NO: 600 - DNA, 30 bp, Artificial Sequence
  Primer
acgttggatgcagaagttaggatgcagatg

SEQ ID NO: 601 - DNA, 31 bp, Artificial Sequence
  Primer
acgttggatgccagtagagatagaattttgg

SEQ ID NO: 602 - DNA, 30 bp, Artificial Sequence
  Primer
acgttggatgcagaaatatgaaggtggccc

SEQ ID NO: 603 - DNA, 30 bp, Artificial Sequence
  Primer
acgttggatgaccttgagctctgagccctt

SEQ ID NO: 604 - DNA, 30 bp, Artificial Sequence
  Primer
acgttggatgaaggatcacgtgaagtcagg

SEQ ID NO: 605 - DNA, 30 bp, Artificial Sequence
  Primer
acgttggatgggcaccatgtgtggctaatt

SEQ ID NO: 606 - DNA, 30 bp, Artificial Sequence
  Primer
acgttggatgtctgactccctgattcaagc

SEQ ID NO: 607 - DNA, 30 bp, Artificial Sequence
  Primer
acgttggatgacaaaaattagccgggcgtg

SEQ ID NO: 608 - DNA, 30 bp, Artificial Sequence
  Primer
acgttggatgtccaggtgttatggagtcag

SEQ ID NO: 609 - DNA, 30 bp, Artificial Sequence
  Primer
acgttggatgggcttcttgtgctgctgtgt

SEQ ID NO: 610 - DNA, 30 bp, Artificial Sequence
  Primer
acgttggatgatgtcaagtgcacccacatg

SEQ ID NO: 611 - DNA, 30 bp, Artificial Sequence
  Primer
acgttggatgaggaagaaactgacggaagg

SEQ ID NO: 612 - DNA, 30 bp, Artificial Sequence
  Primer
acgttggatgtattccactgcctgctttcc

SEQ ID NO: 613 - DNA, 30 bp, Artificial Sequence
  Primer
acgttggatggaaaacaggaggaagtggtg

SEQ ID NO: 614 - DNA, 30 bp, Artificial Sequence
  Primer
acgttggatgttctccactttctggtcaac

SEQ ID NO: 615 - DNA, 30 bp, Artificial Sequence
  Primer
acgttggatgaacaaccttacttcatgccc

SEQ ID NO: 616 - DNA, 30 bp, Artificial Sequence
  Primer
acgttggatgcttcccaacattttcggctc

SEQ ID NO: 617 - DNA, 30 bp, Artificial Sequence
  Primer
acgttggatgtggatactgagggtcaactg

SEQ ID NO: 618 - DNA, 30 bp, Artificial Sequence
  Primer
acgttggatgtgcagccctcaacctttcag

SEQ ID NO: 619 - DNA, 31 bp, Artificial Sequence
  Primer
acgttggatgccttattcagttactattacg

SEQ ID NO: 620 - DNA, 30 bp, Artificial Sequence
  Primer
acgttggatgagttgtgagtgatttcaggg

SEQ ID NO: 621 - DNA, 30 bp, Artificial Sequence
  Primer
acgttggatgcaggccttcttgctcttatc

SEQ ID NO: 622 - DNA, 30 bp, Artificial Sequence
  Primer
acgttggatgatctgttgccttaggttcac

SEQ ID NO: 623 - DNA, 30 bp, Artificial Sequence
  Primer
acgttggatgctgtgccttctgagtagttc

SEQ ID NO: 624 - DNA, 30 bp, Artificial Sequence
  Primer
acgttggatgggctgagtaacagtccattg

SEQ ID NO: 625 - DNA, 30 bp, Artificial Sequence
  Primer
acgttggatgcttacagtatccaaaaaggg

SEQ ID NO: 626 - DNA, 30 bp, Artificial Sequence
  Primer
acgttggatgctcaggtaatctgccttctc

SEQ ID NO: 627 - DNA, 31 bp, Artificial Sequence
  Primer
acgttggatgcagggataatgagaacaaatc

SEQ ID NO: 628 - DNA, 30 bp, Artificial Sequence
  Primer
acgttggatgatcacttggactcaggaagc

SEQ ID NO: 629 - DNA, 30 bp, Artificial Sequence
  Primer
acgttggatgagtcttgctctgtttccagg

SEQ ID NO: 630 - DNA, 30 bp, Artificial Sequence
  Primer
acgttggatgctctcaattccatcagtctc

SEQ ID NO: 631 - DNA, 31 bp, Artificial Sequence
  Primer
acgttggatgctttacgaatttcacaacagg

SEQ ID NO: 632 - DNA, 29 bp, Artificial Sequence
  Primer
acgttggatgacgcgccacacctccctac

SEQ ID NO: 633 - DNA, 30 bp, Artificial Sequence
  Primer
acgttggatgacgtgtcggtcccctttcat

SEQ ID NO: 634 - DNA, 30 bp, Artificial Sequence
  Primer
acgttggatgtgggcgaggttctgcagcgt

SEQ ID NO: 635 - DNA, 30 bp, Artificial Sequence
  Primer
acgttggatggtttcgtttctccggcacag

SEQ ID NO: 636 - DNA, 30 bp, Artificial Sequence
  Primer
acgttggatgtgcggtaaacggtcccagag

SEQ ID NO: 637 - DNA, 31 bp, Artificial Sequence
  Primer
acgttggatgaactccgccggccccctccta

SEQ ID NO: 638 - DNA, 30 bp, Artificial Sequence
  Primer
acgttggatgaacccgcactacaagattcc

SEQ ID NO: 639 - DNA, 30 bp, Artificial Sequence
  Primer
acgttggatggtcagtcccacattcagaac

SEQ ID NO: 640 - DNA, 22 bp, Artificial Sequence
  Primer
tccaaaaccaccagataaaatc

SEQ ID NO: 641 - DNA, 19 bp, Artificial Sequence
  Primer
gacatgtccctctcggcct

SEQ ID NO: 642 - DNA, 17 bp, Artificial Sequence
  Primer
ggtatcaggaagagtca

SEQ ID NO: 643 - DNA, 22 bp, Artificial Sequence
  Primer
agtgcacacagaacatttaaca

SEQ ID NO: 644 - DNA, 17 bp, Artificial Sequence
  Primer
gtattgtcctccagtga

SEQ ID NO: 645 - DNA, 18 bp, Artificial Sequence
  Primer
ctgtaatcccagctactc

SEQ ID NO: 646 - DNA, 17 bp, Artificial Sequence
  Primer
ggcaatgtttgcccttt

SEQ ID NO: 647 - DNA, 21 bp, Artificial Sequence
  Primer
ccctgacaattccaaaactaa

SEQ ID NO: 648 - DNA, 19 bp, Artificial Sequence
  Primer
tttcgccatgtttgccagg

SEQ ID NO: 649 - DNA, 17 bp, Artificial Sequence
  Primer
gagcaggcagcacaagt

SEQ ID NO: 650 - DNA, 19 bp, Artificial Sequence
  Primer
gggagaaagtaacagggtc

SEQ ID NO: 651 - DNA, 17 bp, Artificial Sequence
  Primer
gtgaaggtctgagcaat

SEQ ID NO: 652 - DNA, 17 bp, Artificial Sequence
  Primer
tggtgttaagtggcgtg

SEQ ID NO: 653 - DNA, 20 bp, Artificial Sequence
  Primer
ctaggctagcagtggggttg

SEQ ID NO: 654 - DNA, 17 bp, Artificial Sequence
  Primer
tggtcatacccttcaag

SEQ ID NO: 655 - DNA, 17 bp, Artificial Sequence
  Primer
gaagggtatgaccaagc

SEQ ID NO: 656 - DNA, 17 bp, Artificial Sequence
  Primer
tgagccaagatcatgcc

SEQ ID NO: 657 - DNA, 19 bp, Artificial Sequence
  Primer
ccagggtatgagcggagga

SEQ ID NO: 658 - DNA, 18 bp, Artificial Sequence
  Primer
tgcggcccccgccgggtt

SEQ ID NO: 659 - DNA, 19 bp, Artificial Sequence
  Primer
gaattgcccggctccgaat

SEQ ID NO: 660 - DNA, 17 bp, Artificial Sequence
  Primer
tccaagttgggtcaaag

SEQ ID NO: 661 - DNA, 20 bp, Artificial Sequence
  Primer
ctgctattcatttgtgtaga

SEQ ID NO: 662 - DNA, 22 bp, Artificial Sequence
  Primer
ccctcagtttttattgattatt

SEQ ID NO: 663 - DNA, 23 bp, Artificial Sequence
  Primer
acctccaggtaaaatgattagtt

SEQ ID NO: 664 - DNA, 17 bp, Artificial Sequence
  Primer
tgggcaaacaagcccat

SEQ ID NO: 665 - DNA, 17 bp, Artificial Sequence
  Primer
cagggatggtaattgac

SEQ ID NO: 666 - DNA, 17 bp, Artificial Sequence
  Primer
ggccaccttcatatttc

SEQ ID NO: 667 - DNA, 20 bp, Artificial Sequence
  Primer
caggagatccagaccatccc

SEQ ID NO: 668 - DNA, 19 bp, Artificial Sequence
  Primer
ctctgatgttacctcctcc

SEQ ID NO: 669 - DNA, 17 bp, Artificial Sequence
  Primer
agttgttcagatcctcc

SEQ ID NO: 670 - DNA, 22 bp, Artificial Sequence
  Primer
tcaatctagtgataaggagggt

SEQ ID NO: 671 - DNA, 17 bp, Artificial Sequence
  Primer
caggtggatggggacac

SEQ ID NO: 672 - DNA, 19 bp, Artificial Sequence
  Primer
cacaccaccacgcccggct

SEQ ID NO: 673 - DNA, 21 bp, Artificial Sequence
  Primer
agaatggtggtgtatttttac

SEQ ID NO: 674 - DNA, 20 bp, Artificial Sequence
  Primer
tagtcctacacaatctgtta

SEQ ID NO: 675 - DNA, 20 bp, Artificial Sequence
  Primer
gctatccctccccccttccc

SEQ ID NO: 676 - DNA, 18 bp, Artificial Sequence
  Primer
gacaaaaaaccaaacacc

SEQ ID NO: 677 - DNA, 20 bp, Artificial Sequence
  Primer
ctataaagacacatgcacac

SEQ ID NO: 678 - DNA, 21 bp, Artificial Sequence
  Primer
agatcacattgccaaccccca

SEQ ID NO: 679 - DNA, 20 bp, Artificial Sequence
  Primer
aaagtagcagtttgagacca

SEQ ID NO: 680 - DNA, 20 bp, Artificial Sequence
  Primer
gtctctgaccacttgaccca

SEQ ID NO: 681 - DNA, 20 bp, Artificial Sequence
  Primer
ttgtcagttatgagaccttg

SEQ ID NO: 682 - DNA, 19 bp, Artificial Sequence
  Primer
ggttaggaagaaatctgtg

SEQ ID NO: 683 - DNA, 19 bp, Artificial Sequence
  Primer
cacagatgctcatgggtcc

SEQ ID NO: 684 - DNA, 18 bp, Artificial Sequence
  Primer
ggaggaggcactattaat

SEQ ID NO: 685 - DNA, 20 bp, Artificial Sequence
  Primer
tgtggagacaaggtctcact

SEQ ID NO: 686 - DNA, 17 bp, Artificial Sequence
  Primer
tcaagcgattctcctgc

SEQ ID NO: 687 - DNA, 18 bp, Artificial Sequence
  Primer
ggcagggaagagaagagc

SEQ ID NO: 688 - DNA, 19 bp, Artificial Sequence
  Primer
cacatgcctgctcgccccc

SEQ ID NO: 689 - DNA, 22 bp, Artificial Sequence
  Primer
ccctaaagcatctcacagcccc

SEQ ID NO: 690 - DNA, 18 bp, Artificial Sequence
  Primer
tcatgcccattgggttag

SEQ ID NO: 691 - DNA, 17 bp, Artificial Sequence
  Primer
gggtcaactgtaccaag

SEQ ID NO: 692 - DNA, 20 bp, Artificial Sequence
  Primer
gagatcatttctccttcaac

SEQ ID NO: 693 - DNA, 24 bp, Artificial Sequence
  Primer
atacctcagaatacagcttttttt

SEQ ID NO: 694 - DNA, 20 bp, Artificial Sequence
  Primer
tctcatttctcctctctttc

SEQ ID NO: 695 - DNA, 19 bp, Artificial Sequence
  Primer
tagttgatgaagatttggg

SEQ ID NO: 696 - DNA, 17 bp, Artificial Sequence
  Primer
tccttcttctctgcttt

SEQ ID NO: 697 - DNA, 20 bp, Artificial Sequence
  Primer
aagcggaggttgcagtgagc

SEQ ID NO: 698 - DNA, 17 bp, Artificial Sequence
  Primer
ctcatttccacccttct

SEQ ID NO: 699 - DNA, 18 bp, Artificial Sequence
  Primer
gtcccctttcatctaaac

SEQ ID NO: 700 - DNA, 17 bp, Artificial Sequence
  Primer
tctgcagcgtgcggcga

SEQ ID NO: 701 - DNA, 17 bp, Artificial Sequence
  Primer
cctacccctacggagcc

SEQ ID NO: 702 - DNA, 18 bp, Artificial Sequence
  Primer
gcatcttcaggaatcttg

SEQ ID NO: 703 - DNA, 30 bp, Artificial Sequence
  Primer
acgttggatgtgtcagaaagcaaacctggc

SEQ ID NO: 704 - DNA, 30 bp, Artificial Sequence
  Primer
acgttggatgttacaggcattggagacagc

SEQ ID NO: 705 - DNA, 30 bp, Artificial Sequence
  Primer
acgttggatgctgcataatggtggctttgg

SEQ ID NO: 706 - DNA, 30 bp, Artificial Sequence
  Primer
acgttggatgtgtgggtgttcactttgcag

SEQ ID NO: 707 - DNA, 30 bp, Artificial Sequence
  Primer
acgttggatgccctcttgtcaggaagttct

SEQ ID NO: 708 - DNA, 30 bp, Artificial Sequence
  Primer
acgttggatggagacagagttgaactcccg

SEQ ID NO: 709 - DNA, 30 bp, Artificial Sequence; identical to SEQ ID NO: 611
  Primer

SEQ ID NO: 710 - DNA, 30 bp, Artificial Sequence; identical to SEQ ID NO: 610
  Primer

SEQ ID NO: 711 - DNA, 30 bp, Artificial Sequence
  Primer
acgttggatgaagatacgaatggagcctgg

SEQ ID NO: 712 - DNA, 30 bp, Artificial Sequence
  Primer
acgttggatggcaataggactccctttacc

SEQ ID NO: 713 - DNA, 17 bp, Artificial Sequence
  Primer
tgatgcacgtggagcag

SEQ ID NO: 714 - DNA, 17 bp, Artificial Sequence
  Primer
gcccctggaaaaggccc

SEQ ID NO: 715 - DNA, 20 bp, Artificial Sequence
  Primer
ggaagatgatgagactaaat

SEQ ID NO: 716 - DNA, 19 bp, Artificial Sequence
  Primer
cacatgcctgctcgccccc

SEQ ID NO: 717 - DNA, 17 bp, Artificial Sequence
  Primer
tccctttaccttcatgg

SEQ ID NO: 718 - DNA, 30 bp, Artificial Sequence
  Primer
acgttggatgtctgcagacagtggccaatg

SEQ ID NO: 719 - DNA, 30 bp, Artificial Sequence
  Primer
acgttggatgagggcccaggatcacaatag

SEQ ID NO: 720 - DNA, 30 bp, Artificial Sequence
  Primer
acgttggatgttcatctggtaagtcccacc

SEQ ID NO: 721 - DNA, 30 bp, Artificial Sequence
  Primer
acgttggatgtgaaacaagagaggcccttc

SEQ ID NO: 722 - DNA, 30 bp, Artificial Sequence
  Primer
acgttggatgtctttaggtccaggattccc

SEQ ID NO: 723 - DNA, 30 bp, Artificial Sequence
  Primer
acgttggatgtatagtcagcatcgtccctg

SEQ ID NO: 724 - DNA, 30 bp, Artificial Sequence
  Primer
acgttggatgccctcagagtttggacatat

SEQ ID NO: 725 - DNA, 30 bp, Artificial Sequence
  Primer
acgttggatgtatccaaaatgcagacacag

SEQ ID NO: 726 - DNA, 30 bp, Artificial Sequence
  Primer
acgttggatggtgtttatcccaacccttcc

SEQ ID NO: 727 - DNA, 30 bp, Artificial Sequence
  Primer
acgttggatgggaggaaatacagcctgttc

SEQ ID NO: 728 - DNA, 30 bp, Artificial Sequence
  Primer
acgttggatgatcctagaggactgggaaag

SEQ ID NO: 729 - DNA, 30 bp, Artificial Sequence
  Primer
acgttggatgctgcttctgttcccacaatg

SEQ ID NO: 730 - DNA, 30 bp, Artificial Sequence
  Primer
acgttggatgaagggtggagaactcatggg

SEQ ID NO: 731 - DNA, 30 bp, Artificial Sequence
  Primer
acgttggatgacccctattttgaagcaggc

SEQ ID NO: 732 - DNA, 30 bp, Artificial Sequence
  Primer
acgttggatgttcacaccaaggtgttactg

SEQ ID NO: 733 - DNA, 30 bp, Artificial Sequence
  Primer
acgttggatgcacaataatgtgttcagggc

SEQ ID NO: 734 - DNA, 30 bp, Artificial Sequence
  Primer
acgttggatgctgggcaacaagagtgaaac

SEQ ID NO: 735 - DNA, 30 bp, Artificial Sequence
  Primer
acgttggatggcccaaaaccactgagattc

SEQ ID NO: 736 - DNA, 30 bp, Artificial Sequence
  Primer
acgttggatgtagagtgaagacagagctcc

SEQ ID NO: 737 - DNA, 30 bp, Artificial Sequence
  Primer
acgttggatgataaacccaggcattcgagc

SEQ ID NO: 738 - DNA, 30 bp, Artificial Sequence
  Primer
acgttggatgtcctatgaagattcatctgc

SEQ ID NO: 739 - DNA, 31 bp, Artificial Sequence
  Primer
acgttggatggtccagagttttagactcaag

SEQ ID NO: 740 - DNA, 30 bp, Artificial Sequence
  Primer
acgttggatgtccttaaccttattggtggc

SEQ ID NO: 741 - DNA, 30 bp, Artificial Sequence
  Primer
acgttggatggttgggttcagtagaagaga

SEQ ID NO: 742 - DNA, 30 bp, Artificial Sequence
  Primer
acgttggatgagccaccaataaggttaagg

SEQ ID NO: 743 - DNA, 30 bp, Artificial Sequence
  Primer
acgttggatgtgtctctcacttcctcaacc

SEQ ID NO: 744 - DNA, 30 bp, Artificial Sequence
  Primer
acgttggatgagacacacaaggcaaggttc

SEQ ID NO: 745 - DNA, 30 bp, Artificial Sequence
  Primer
acgttggatgccagagaggagtctgtctag

SEQ ID NO: 746 - DNA, 30 bp, Artificial Sequence
  Primer
acgttggatggaaaacattggtccaggcag

SEQ ID NO: 747 - DNA, 30 bp, Artificial Sequence
  Primer
acgttggatgcaagaacccaggcatcaatg

SEQ ID NO: 748 - DNA, 31 bp, Artificial Sequence
  Primer
acgttggatggaccacggaatccttttttca

SEQ ID NO: 749 - DNA, 30 bp, Artificial Sequence
  Primer
acgttggatggctcaaattctgttctttag

SEQ ID NO: 750 - DNA, 30 bp, Artificial Sequence
  Primer
acgttggatgacataggtagtcaggcactc

SEQ ID NO: 751 - DNA, 30 bp, Artificial Sequence
  Primer
acgttggatggcagctctttttttcctacc

SEQ ID NO: 752 - DNA, 30 bp, Artificial Sequence
  Primer
acgttggatggggaacttttcacattacac

SEQ ID NO: 753 - DNA, 31 bp, Artificial Sequence
  Primer
acgttggatggagagtttgcatttggtgatc

SEQ ID NO: 754 - DNA, 30 bp, Artificial Sequence
  Primer
acgttggatgatgttgctgtatggtcctcc

SEQ ID NO: 755 - DNA, 30 bp, Artificial Sequence
  Primer
acgttggatggaaaacattgcgctaggcac

SEQ ID NO: 756 - DNA, 30 bp, Artificial Sequence
  Primer
acgttggatgtgagtgaccaagttgctctg

SEQ ID NO: 757 - DNA, 30 bp, Artificial Sequence
  Primer
acgttggatgtctaccttcatgatgtcccc

SEQ ID NO: 758 - DNA, 31 bp, Artificial Sequence
  Primer
acgttggatgggtcttttatgaggtttctcc

SEQ ID NO: 759 - DNA, 30 bp, Artificial Sequence
  Primer
acgttggatggttaaacttacaaatctagc

SEQ ID NO: 760 - DNA, 30 bp, Artificial Sequence
  Primer
acgttggatggctgagtgtggattgctctg

SEQ ID NO: 761 - DNA, 30 bp, Artificial Sequence
  Primer
acgttggatgagtaaaccaacacccagaac

SEQ ID NO: 762 - DNA, 30 bp, Artificial Sequence
  Primer
acgttggatgtgaagcaggctttcccaatg

SEQ ID NO: 763 - DNA, 30 bp, Artificial Sequence
  Primer
acgttggatgggtagtgaagggtggagaac

SEQ ID NO: 764 - DNA, 30 bp, Artificial Sequence
  Primer
acgttggatgaagaaataccaggccgggag

SEQ ID NO: 765 - DNA, 30 bp, Artificial Sequence
  Primer
acgttggatgctcaagtatcctcccttctc

SEQ ID NO: 766 - DNA, 30 bp, Artificial Sequence
  Primer
acgttggatgaggcaatgcttccattgttc

SEQ ID NO: 767 - DNA, 30 bp, Artificial Sequence
  Primer
acgttggatgtcatagcattttacccctgg

SEQ ID NO: 768 - DNA, 30 bp, Artificial Sequence
  Primer
acgttggatggctacatatggatcttggtc

SEQ ID NO: 769 - DNA, 30 bp, Artificial Sequence
  Primer
acgttggatggaccagcactaactctaaac

SEQ ID NO: 770 - DNA, 30 bp, Artificial Sequence
  Primer
acgttggatgctcctctgtaaaaccaggac

SEQ ID NO: 771 - DNA, 30 bp, Artificial Sequence
  Primer
acgttggatgagaaactctcctaagcacac

SEQ ID NO: 772 - DNA, 30 bp, Artificial Sequence
  Primer
acgttggatggttccctgatggaaaatgcc

SEQ ID NO: 773 - DNA, 30 bp, Artificial Sequence
  Primer
acgttggatgccagaatgccttatccacag

SEQ ID NO: 774 - DNA, 30 bp, Artificial Sequence
  Primer
acgttggatgtgactctgctgtgagattgg

SEQ ID NO: 775 - DNA, 30 bp, Artificial Sequence
  Primer
acgttggatgacatcggtttcacctccaac

SEQ ID NO: 776 - DNA, 30 bp, Artificial Sequence
  Primer
acgttggatgagccagcagagaaaacagtc

SEQ ID NO: 777 - DNA, 30 bp, Artificial Sequence
  Primer
acgttggatggccacttactacctgttgtc

SEQ ID NO: 778 - DNA, 30 bp, Artificial Sequence
  Primer
acgttggatgggacataaccataggccatc

SEQ ID NO: 779 - DNA, 30 bp, Artificial Sequence
  Primer
acgttggatgcattgacagctgtattgcac

SEQ ID NO: 780 - DNA, 30 bp, Artificial Sequence
  Primer
acgttggatgtttttgagacggagtctcgc

SEQ ID NO: 781 - DNA, 30 bp, Artificial Sequence
  Primer
acgttggatgaggcaggagaatggcgtgaa

SEQ ID NO: 782 - DNA, 30 bp, Artificial Sequence
  Primer
acgttggatgagcttgcagtgagccgagat

SEQ ID NO: 783 - DNA, 30 bp, Artificial Sequence; identical to SEQ ID NO: 780
  Primer

SEQ ID NO: 784 - DNA, 30 bp, Artificial Sequence
  Primer
acgttggatgtggtgaagagaagtcaaagc

SEQ ID NO: 785 - DNA, 30 bp, Artificial Sequence
  Primer
acgttggatgaggctgaatgattccccttc

SEQ ID NO: 786 - DNA, 30 bp, Artificial Sequence
  Primer
acgttggatgtggtcagtcagttagccagg

SEQ ID NO: 787 - DNA, 30 bp, Artificial Sequence
  Primer
acgttggatgccctaatgatggtagactgc

SEQ ID NO: 788 - DNA, 30 bp, Artificial Sequence
  Primer
acgttggatgaccaccaagataacgaccgc

SEQ ID NO: 789 - DNA, 30 bp, Artificial Sequence
  Primer
acgttggatgagccacctccttgtccagtg

SEQ ID NO: 790 - DNA, 31 bp, Artificial Sequence
  Primer
acgttggatgggacaatatttagttatgcac

SEQ ID NO: 791 - DNA, 30 bp, Artificial Sequence
  Primer
acgttggatgttcaaggtcatcccgttatc

SEQ ID NO: 792 - DNA, 19 bp, Artificial Sequence
  Primer
gatggcccagttccctgcc

SEQ ID NO: 793 - DNA, 18 bp, Artificial Sequence
  Primer
agaggcccttccagggct

SEQ ID NO: 794 - DNA, 19 bp, Artificial Sequence
  Primer
cgtccctgacctggactta

SEQ ID NO: 795 - DNA, 20 bp, Artificial Sequence
  Primer
aatgcagacacagttctggg

SEQ ID NO: 796 - DNA, 18 bp, Artificial Sequence
  Primer
ctgaaaaatagctagttc

SEQ ID NO: 797 - DNA, 20 bp, Artificial Sequence
  Primer
actcacctctacccataagg

SEQ ID NO: 798 - DNA, 18 bp, Artificial Sequence
  Primer
ttgaagcaggctttccca

SEQ ID NO: 799 - DNA, 20 bp, Artificial Sequence
  Primer
tgtgttcagggctttctcat

SEQ ID NO: 800 - DNA, 18 bp, Artificial Sequence
  Primer
gtgttttttttttccccc

SEQ ID NO: 801 - DNA, 20 bp, Artificial Sequence
  Primer
caggcattcgagccagcaat

SEQ ID NO: 802 - DNA, 23 bp, Artificial Sequence
  Primer
atgttttattctttcacaaaagt

SEQ ID NO: 803 - DNA, 18 bp, Artificial Sequence
  Primer
ggaggaggcagtaaggaa

SEQ ID NO: 804 - DNA, 20 bp, Artificial Sequence
  Primer
cttccaacttttttctcttg

SEQ ID NO: 805 - DNA, 17 bp, Artificial Sequence
  Primer
gtctagtcctccaagcc

SEQ ID NO: 806 - DNA, 17 bp, Artificial Sequence
  Primer
atcaatggggtggtgca

SEQ ID NO: 807 - DNA, 18 bp, Artificial Sequence
  Primer
tctgttctttagaaggct

SEQ ID NO: 808 - DNA, 23 bp, Artificial Sequence
  Primer
tgtaccaatatgacaatttaacc

SEQ ID NO: 809 - DNA, 21 bp, Artificial Sequence
  Primer
cctgacacatagttcatgctc

SEQ ID NO: 810 - DNA, 23 bp, Artificial Sequence
  Primer
gctaggcacaaaattaaagagat

SEQ ID NO: 811 - DNA, 17 bp, Artificial Sequence
  Primer
tccccgcctttccctcc

SEQ ID NO: 812 - DNA, 19 bp, Artificial Sequence
  Primer
acaaatctagcaccgaagg

SEQ ID NO: 813 - DNA, 24 bp, Artificial Sequence
  Primer
atataagcaattcacaagtaatgt

SEQ ID NO: 814 - DNA, 19 bp, Artificial Sequence
  Primer
aagggtggagaactcatgg

SEQ ID NO: 815 - DNA, 20 bp, Artificial Sequence
  Primer
tatcctcccttctcagcaag

SEQ ID NO: 816 - DNA, 20 bp, Artificial Sequence
  Primer
cattttacccctggattata

SEQ ID NO: 817 - DNA, 18 bp, Artificial Sequence
  Primer
ctcaacctcaactcaact

SEQ ID NO: 818 - DNA, 23 bp, Artificial Sequence
  Primer
tctcctaagcacactatgtatat

SEQ ID NO: 819 - DNA, 20 bp, Artificial Sequence
  Primer
aggatattagtcatgctggg

SEQ ID NO: 820 - DNA, 19 bp, Artificial Sequence
  Primer
cacctccaacacggtcccc

SEQ ID NO: 821 - DNA, 17 bp, Artificial Sequence
  Primer
gttgtcttcccaactcc

SEQ ID NO: 822 - DNA, 17 bp, Artificial Sequence
  Primer
actgtggacattggtgt

SEQ ID NO: 823 - DNA, 17 bp, Artificial Sequence
  Primer
ggcgtgaacccgggagg

SEQ ID NO: 824 - DNA, 17 bp, Artificial Sequence
  Primer
ctgtcgcccaggccgga

SEQ ID NO: 825 - DNA, 18 bp, Artificial Sequence
  Primer
gattccccttcttctaaa

SEQ ID NO: 826 - DNA, 17 bp, Artificial Sequence
  Primer
tagactgcagagtagca

SEQ ID NO: 827 - DNA, 17 bp, Artificial Sequence
  Primer
tgggcctacttccctga

SEQ ID NO: 828 - DNA, 21 bp, Artificial Sequence
  Primer
ttttcatcacatagctcatct

SEQ ID NO: 829 - RNA, 19 nt, Artificial Sequence
  Primer
acaaccggaagguguauga

SEQ ID NO: 830 - RNA, 19 nt, Artificial Sequence
  Primer
gccaaccaaugugcuauuc

SEQ ID NO: 831 - RNA, 19 nt, Artificial Sequence
  Primer
gaucaccauggagccaauu

SEQ ID NO: 832 - RNA, 19 nt, Artificial Sequence
  Primer
cugucacucgagaucuuga

SEQ ID NO: 833 - RNA, 19 nt, Artificial Sequence
  Primer
gaguuggauagcaagacaa

SEQ ID NO: 834 - RNA, 19 nt, Artificial Sequence
  Primer
cguacgcggaauacuucga

SEQ ID NO: 835 - DNA, 23 bp, Artificial Sequence
  Illustrative polynucleotide sequence
  modified_base (3)..(21): a, t, c or g
aannnnnnnnnnnnnnnnnnntt

What is claimed is:

1. A method for determining whether a human subject is at an increased risk or decreased risk of breast cancer, which comprises:
    (a) detecting in a nucleic acid of the human subject the presence of a polymorphic variant selected from the group consisting of a guanine corresponding to position 7573 of SEQ ID NO: 2, a guanine corresponding to position 13903 of SEQ ID NO: 2, an adenine corresponding to position 23826 of SEQ ID NO: 2, an adenine corresponding to position 26057 of SEQ ID NO: 2, a thymine corresponding to position 26361 of SEQ ID NO: 2, an adenine corresponding to position 26599 of SEQ ID NO: 2, an adenine corresponding to position 26812 of SEQ ID NO: 2, a cytosine corresponding to position 27069 of SEQ ID NO: 2, an adenine corresponding to position 35127 of SEQ ID NO: 2, a thymine corresponding to position 35222 of SEQ ID NO: 2, a cytosine corresponding to position 36424 of SEQ ID NO: 2, a cytosine corresponding to position 46176 of SEQ ID NO: 2, a cytosine corresponding to position 50452 of SEQ ID NO: 2, a guanine corresponding to position 61093 of SEQ ID NO: 2, an adenine corresponding to position 62572 of SEQ ID NO: 2, a guanine corresponding to position 70759 of SEQ ID NO: 2, and the complement of the foregoing; or
    (b) detecting in a nucleic acid of the human subject the presence of a polymorphic variant selected from the group consisting of an adenine corresponding to position 7573 of SEQ ID NO: 2, a cytosine corresponding to position 13903 of SEQ ID NO: 2, a thymine corresponding to position 23826 of SEQ ID NO: 2, a guanine corresponding to position 26057 of SEQ ID NO: 2, a cytosine corresponding to position 26361 of SEQ ID NO: 2, a guanine corresponding to position 26599 of SEQ ID NO: 2, a guanine corresponding to position 26812 of SEQ ID NO: 2, a thymine corresponding to position 27069 of SEQ ID NO: 2, a guanine corresponding to position 35127 of SEQ ID NO: 2, a guanine corresponding to position 35222 of SEQ ID NO: 2, a thymine corresponding to position 36424 of SEQ ID NO: 2, a guanine corresponding to position 46176 of SEQ ID NO: 2, a thymine corresponding to position 50452 of SEQ ID NO: 2, a cytosine corresponding to position 61093 of SEQ ID NO: 2, a guanine corresponding to position 62572 of SEQ ID NO: 2, an adenine corresponding to position 70759 of SEQ ID NO: 2, and the complement of the foregoing;
    whereby it is determined that the subject is at an increased risk of breast cancer based on the presence of one or more of the polymorphic variants of (a), and whereby it is determined that the subject is at a decreased risk of breast cancer based on the presence of one or more of the polymorphic variations of (b).

2. The method of claim 1, which further comprises obtaining the nucleic acid sample from the subject.

3. The method of claim 1, wherein detecting the presence of the one or more polymorphic variants comprises:
    hybridizing an oligonucleotide to the nucleic acid from the subject, wherein the oligonucleotide is complementary to a nucleotide sequence in the nucleic acid and hybridizes to a region adjacent to the polymorphic variant;
    extending the oligonucleotide in the presence of one or more nucleotides, yielding extension products; and
    detecting the presence of polymorphic variant in the extension products.

4. The method of claim 1, wherein the polymorphic variant detected is a guanine corresponding to position 7573 of SEQ ID NO: 2, or a complement thereof.

5. The method of claim 1, wherein the polymorphic variant detected is a guanine corresponding to position 13903 of SEQ ID NO: 2, or a complement thereof.

6. The method of claim 1, wherein the polymorphic variant detected is an adenine corresponding to position 23826 of SEQ ID NO: 2, or a complement thereof.

7. The method of claim 1, wherein the polymorphic variant detected is an adenine corresponding to position 26057 of SEQ ID NO: 2, or a complement thereof.

8. The method of claim 1, wherein the polymorphic variant detected is a thymine corresponding to position 26361 of SEQ ID NO: 2, or a complement thereof.

9. The method of claim 1, wherein the polymorphic variant detected is an adenine corresponding to position 26599 of SEQ ID NO: 2, or a complement thereof.

10. The method of claim 1, wherein the polymorphic variant detected is an adenine corresponding to position 26812 of SEQ ID NO: 2, or a complement thereof.

11. The method of claim 1, wherein the polymorphic variant detected is a cytosine corresponding to position 27069 of SEQ ID NO: 2, or a complement thereof.

12. The method of claim 1, wherein the polymorphic variant detected is an adenine corresponding to position 35127 of SEQ ID NO: 2, or a complement thereof.

13. The method of claim 1, wherein the polymorphic variant detected is a thymine corresponding to position 35222 of SEQ ID NO: 2, or a complement thereof.

14. The method of claim 1, wherein the polymorphic variant detected is a cytosine corresponding to position 36424 of SEQ ID NO: 2, or a complement thereof.

15. The method of claim 1, wherein the polymorphic variant detected is a cytosine corresponding to position 46176 of SEQ ID NO: 2, or a complement thereof.

16. The method of claim 1, wherein the polymorphic variant detected is a cytosine corresponding to position 50452 of SEQ ID NO: 2, or a complement thereof.

17. The method of claim 1, wherein the polymorphic variant detected is a guanine corresponding to position 61093 of SEQ ID NO: 2, or a complement thereof.

18. The method of claim 1, wherein the polymorphic variant detected is an adenine corresponding to position 62572 of SEQ ID NO: 2, or a complement thereof.

19. The method of claim 1, wherein the polymorphic variant detected is a guanine corresponding to position 70759 of SEQ ID NO: 2, or a complement thereof.

20. The method of claim 1, wherein the polymorphic variant detected is an adenine corresponding to position 7573 of SEQ ID NO: 2, or a complement thereof.

21. The method of claim 1, wherein the polymorphic variant detected is a cytosine corresponding to position 13903 of SEQ ID NO: 2, or a complement thereof.

22. The method of claim 1, wherein the polymorphic variant detected is a thymine corresponding to position 23826 of SEQ ID NO: 2, or a complement thereof.

23. The method of claim 1, wherein the polymorphic variant detected is a guanine corresponding to position 26057 of SEQ ID NO: 2, or a complement thereof.

24. The method of claim 1, wherein the polymorphic variant detected is a cytosine corresponding to position 26361 of SEQ ID NO: 2, or a complement thereof.

25. The method of claim 1, wherein the polymorphic variant detected is a guanine corresponding to position 26599 of SEQ ID NO: 2, or a complement thereof.

26. The method of claim 1, wherein the polymorphic variant detected is a guanine corresponding to position 26812 of SEQ ID NO: 2, or a complement thereof.

27. The method of claim 1, wherein the polymorphic variant detected is a thymine corresponding to position 27069 of SEQ ID NO: 2, or a complement thereof.

28. The method of claim 1, wherein the polymorphic variant detected is a guanine corresponding to position 35127 of SEQ ID NO: 2, or a complement thereof.

29. The method of claim 1, wherein the polymorphic variant detected is a guanine corresponding to position 35222 of SEQ ID NO: 2, or a complement thereof.

30. The method of claim 1, wherein the polymorphic variant detected is a thymine corresponding to position 36424 of SEQ ID NO: 2, or a complement thereof.

31. The method of claim 1, wherein the polymorphic variant detected is a guanine corresponding to position 46176 of SEQ ID NO: 2, or a complement thereof.

32. The method of claim 1, wherein the polymorphic variant detected is a thymine corresponding to position 50452 of SEQ ID NO: 2, or a complement thereof.

33. The method of claim 1, wherein the polymorphic variant detected is a cytosine corresponding to position 61093 of SEQ ID NO: 2, or a complement thereof.

34. The method of claim 1, wherein the polymorphic variant detected is a guanine corresponding to position 62572 of SEQ ID NO: 2, or a complement thereof.

35. The method of claim 1, wherein the polymorphic variant detected is an adenine corresponding to position 70759 of SEQ ID NO: 2, or a complement thereof.

36. The method of claim 1, wherein the human subject is Caucasian.

37. A method for determining whether a breast cancer detection procedure is administered to a human subject, which comprises:
   (a) detecting in a nucleic acid of the human subject the presence of a polymorphic variant selected from the group consisting of a guanine corresponding to position 7573 of SEQ ID NO: 2, a guanine corresponding to position 13903 of SEQ ID NO: 2, an adenine corresponding to position 23826 of SEQ ID NO: 2, an adenine corresponding to position 26057 of SEQ ID NO: 2, a thymine corresponding to position 26361 of SEQ ID NO: 2, an adenine corresponding to position 26599 of SEQ ID NO: 2, an adenine corresponding to position 26812 of SEQ ID NO: 2, a cytosine corresponding to position 27069 of SEQ ID NO: 2, an adenine corresponding to position 35127 of SEQ ID NO: 2, a thymine corresponding to position 35222 of SEQ ID NO: 2, a cytosine corresponding to position 36424 of SEQ ID NO: 2, a cytosine corresponding to position 46176 of SEQ ID NO: 2, a cytosine corresponding to position 50452 of SEQ ID NO: 2, a guanine corresponding to position 61093 of SEQ ID NO: 2, an adenine corresponding to position 62572 of SEQ ID NO: 2, a guanine corresponding to position 70759 of SEQ ID NO: 2, and the complement of the foregoing; or
   (b) detecting in a nucleic acid of the human subject the presence of a polymorphic variant selected from the group consisting of an adenine corresponding to position 7573 of SEQ ID NO: 2, a cytosine corresponding to position 13903 of SEQ ID NO: 2, a thymine corresponding to position 23826 of SEQ ID NO: 2, a guanine corresponding to position 26057 of SEQ ID NO: 2, a cytosine corresponding to position 26361 of SEQ ID NO: 2, a guanine corresponding to position 26599 of SEQ ID NO: 2, a guanine corresponding to position 26812 of SEQ ID NO: 2, a thymine corresponding to position 27069 of SEQ ID NO: 2, a guanine corresponding to position 35127 of SEQ ID NO: 2, a guanine corresponding to position 35222 of SEQ ID NO: 2, a thymine corresponding to position 36424 of SEQ ID NO: 2, a guanine corresponding to position 46176 of SEQ ID NO: 2, a thymine corresponding to position 50452 of SEQ ID NO: 2, a cytosine corresponding to position 61093 of SEQ ID NO: 2, a guanine corresponding to position 62572 of SEQ ID NO: 2, an adenine corresponding to position 70759 of SEQ ID NO: 2, and the complement of the foregoing; and
   administering a breast cancer detection procedure to a human subject determined to have an increased risk of breast cancer based on the presence of the one or more polymorphic variants of (a), or determining that a human subject is at decreased risk of breast cancer based on the presence of one or polymorphic variants of (b) and not administering a breast cancer detection procedure.

38. The method of claim 37, which further comprises obtaining the nucleic acid sample from the subject.

39. The method of claim 37, wherein detecting the presence of the one or more polymorphic variants comprises:
   hybridizing an oligonucleotide to the nucleic acid from the subject, wherein the oligonucleotide is complementary to a nucleotide sequence in the nucleic acid and hybridizes to a region adjacent to the polymorphic variant;
   extending the oligonucleotide in the presence of one or more nucleotides, yielding extension products; and
   detecting the presence a polymorphic variant in the extension products.

40. The method of claim 37, wherein the breast cancer detection procedure is selected from the group consisting of a mammography, an early mammography program, a frequent mammography program, a biopsy procedure, a breast biopsy and biopsy from another tissue, a breast ultrasound and optionally ultrasound analysis of another tissue, breast magnetic resonance imaging (MRI) and optionally MRI analysis of another tissue, electrical impedance (T-scan) analysis of breast and optionally of another tissue, ductal lavage, nuclear medicine analysis, scintimammography, BRCA1 and/or BRCA2 sequence analysis results, thermal imaging of the breast and optionally of another tissue, and a combination of the foregoing.

41. The method of claim 37, wherein the polymorphic variant detected is a guanine corresponding to position 7573 of SEQ ID NO: 2, or a complement thereof.

42. The method of claim 37, wherein the polymorphic variant detected is a guanine corresponding to position 13903 of SEQ ID NO: 2, or a complement thereof.

43. The method of claim 37, wherein the polymorphic variant detected is an adenine corresponding to position 23826 of SEQ ID NO: 2, or a complement thereof.

44. The method of claim 37, wherein the polymorphic variant detected is an adenine corresponding to position 26057 of SEQ ID NO: 2, or a complement thereof.

45. The method of claim 37, wherein the polymorphic variant detected is a thymine corresponding to position 26361 of SEQ ID NO: 2, or a complement thereof.

46. The method of claim 37, wherein the polymorphic variant detected is an adenine corresponding to position 26599 of SEQ ID NO: 2, or a complement thereof.

47. The method of claim 37, wherein the polymorphic variant detected is an adenine corresponding to position 26812 of SEQ ID NO: 2, or a complement thereof.

48. The method of claim 37, wherein the polymorphic variant detected is a cytosine corresponding to position 27069 of SEQ ID NO: 2, or a complement thereof.

49. The method of claim 37, wherein the polymorphic variant detected is an adenine corresponding to position 35127 of SEQ ID NO: 2, or a complement thereof.

50. The method of claim 37, wherein the polymorphic variant detected is a thymine corresponding to position 35222 of SEQ ID NO: 2, or a complement thereof.

51. The method of claim 37, wherein the polymorphic variant detected is a cytosine corresponding to position 36424 of SEQ ID NO: 2, or a complement thereof.

52. The method of claim 37, wherein the polymorphic variant detected is a cytosine corresponding to position 46176 of SEQ ID NO: 2, or a complement thereof.

53. The method of claim 37, wherein the polymorphic variant detected is a cytosine corresponding to position 50452 of SEQ ID NO: 2, or a complement thereof.

54. The method of claim 37, wherein the polymorphic variant detected is a guanine corresponding to position 61093 of SEQ ID NO: 2, or a complement thereof.

55. The method of claim 37, wherein the polymorphic variant detected is an adenine corresponding to position 62572 of SEQ ID NO: 2, or a complement thereof.

56. The method of claim 37, wherein the polymorphic variant detected is a guanine corresponding to position 70759 of SEQ ID NO: 2, or a complement thereof.

57. The method of claim 37, wherein the polymorphic variant detected is an adenine corresponding to position 7573 of SEQ ID NO: 2, or a complement thereof.

58. The method of claim 37, wherein the polymorphic variant detected is a cytosine corresponding to position 13903 of SEQ ID NO: 2, or a complement thereof.

59. The method of claim 37, wherein the polymorphic variant detected is a thymine corresponding to position 23826 of SEQ ID NO: 2, or a complement thereof.

60. The method of claim 37, wherein the polymorphic variant detected is a guanine corresponding to position 26057 of SEQ ID NO: 2, or a complement thereof.

61. The method of claim 37, wherein the polymorphic variant detected is a cytosine corresponding to position 26361 of SEQ ID NO: 2, or a complement thereof.

62. The method of claim 37, wherein the polymorphic variant detected is a guanine corresponding to position 26599 of SEQ ID NO: 2, or a complement thereof.

63. The method of claim 37, wherein the polymorphic variant detected is a guanine corresponding to position 26812 of SEQ ID NO: 2, or a complement thereof.

64. The method of claim 37, wherein the polymorphic variant detected is a thymine corresponding to position 27069 of SEQ ID NO: 2, or a complement thereof.

65. The method of claim 37, wherein the polymorphic variant detected is a guanine corresponding to position 35127 of SEQ ID NO: 2, or a complement thereof.

66. The method of claim 37, wherein the polymorphic variant detected is a guanine corresponding to position 35222 of SEQ ID NO: 2, or a complement thereof.

67. The method of claim 37, wherein the polymorphic variant detected is a thymine corresponding to position 36424 of SEQ ID NO: 2, or a complement thereof.

68. The method of claim 37, wherein the polymorphic variant detected is a guanine corresponding to position 46176 of SEQ ID NO: 2, or a complement thereof.

69. The method of claim 37, wherein the polymorphic variant detected is a thymine corresponding to position 50452 of SEQ ID NO: 2, or a complement thereof.

70. The method of claim 37, wherein the polymorphic variant detected is a cytosine corresponding to position 61093 of SEQ ID NO: 2, or a complement thereof.

71. The method of claim 37, wherein the polymorphic variant detected is a guanine corresponding to position 62572 of SEQ ID NO: 2, or a complement thereof.

72. The method of claim 37, wherein the polymorphic variant detected is an adenine corresponding to position 70759 of SEQ ID NO: 2, or a complement thereof.

73. The method of claim 37, wherein the human subject is Caucasian.

* * * * *

UNITED STATES PATENT AND TRADEMARK OFFICE
CERTIFICATE OF CORRECTION

PATENT NO.         : 7,510,835 B2                                        Page 1 of 1
APPLICATION NO. : 10/723681
DATED              : March 31, 2009
INVENTOR(S)        : Richard B. Roth et al.

It is certified that error appears in the above-identified patent and that said Letters Patent is hereby corrected as shown below:

Column 129
    Claim 3, line 66: insert the word --a-- between the words "of" and "polymorphic."

Column 130
    Claim 37, line 18: insert the word --more-- between the words "or" and "polymorphic."

Column 130
    Claims 4 through 35 and claims 41 through 72: delete the word "a" and insert instead the word --the-- between the words "or" and "complement."

Signed and Sealed this

Seventh Day of July, 2009

JOHN DOLL
*Acting Director of the United States Patent and Trademark Office*